United States Patent
Sette et al.

(10) Patent No.: US 8,017,745 B2
(45) Date of Patent: Sep. 13, 2011

(54) PLASMODIUM FALCIPARUM ANTIGENS AND METHODS OF USE

(75) Inventors: Alessandro Sette, La Jolla, CA (US); Denise L. Doolan, Rockville, MD (US); Daniel J. Carucci, Washington, DC (US); John Sidney, San Diego, CA (US); Scott Southwood, Santee, CA (US)

(73) Assignees: Epimmune Inc., San Diego, CA (US); The United States of America as represented by the Secretary of the Navy, Washington, DC (US)

( * ) Notice: Subject to any disclaimer, the term of this patent is extended or adjusted under 35 U.S.C. 154(b) by 996 days.

(21) Appl. No.: 10/537,642

(22) PCT Filed: Dec. 8, 2003

(86) PCT No.: PCT/US03/38966
§ 371 (c)(1),
(2), (4) Date: Dec. 27, 2005

(87) PCT Pub. No.: WO2004/053086
PCT Pub. Date: Jun. 24, 2004

(65) Prior Publication Data
US 2006/0165719 A1 Jul. 27, 2006

Related U.S. Application Data

(60) Provisional application No. 60/431,494, filed on Dec. 6, 2002.

(51) Int. Cl.
*C07H 21/02* (2006.01)
*A61K 39/015* (2006.01)
*A61K 45/00* (2006.01)
*A61B 5/055* (2006.01)
*C12N 5/00* (2006.01)
*C12N 15/00* (2006.01)

(52) U.S. Cl. .............. 536/23.1; 424/268.1; 424/272.1; 424/278.1; 424/802; 424/9.341; 435/410; 435/320.1

(58) Field of Classification Search ............... None
See application file for complete search history.

(56) References Cited

U.S. PATENT DOCUMENTS
5,766,597 A 6/1998 Paoletti et al.

FOREIGN PATENT DOCUMENTS
WO WO 87/03882 A1 7/1987
WO WO 00/25728 * 5/2000
WO WO 01/27287 A2 4/2001

OTHER PUBLICATIONS

Hackett et al. (Molecular and Biochemical Parasitology, 1999; 103: 183-195).*
Greenspan et al. (Nature Biotechnology 17: 936-937, 1999).*
Overbeek (1994, "Factors affecting transgenic animal production," Transgenic animal technology, pp. 96-98).*
Wall (Theriogenology, 1996; 45: 57-68).*
Houdebine (J. Biotech., 1994; 34: 269-287, specifically p. 281).*
Kappell (Current Opinions in Biotechnology, 1992; 3: 548-553).*
Cameron (Molec. Biol., 1997; 7: 253-265).*
Niemann (Transg. Res., 1997; 7: 73-75.*
Mullins ( Hypertension, 1993; 22: 630-633).*
Mullins (Nature, 1990; 344: 541-544).*
Hammer (Cell, 1990; 63: 1099-1112).*
Mullins (EMBO J., 1989; 8: 4065-4072).*
Taurog (Jour. Immunol., 1988; 141: 4020-4023).*
Mullins (J. Clin. Invest., 1996; 98: S37-S40).*
(Cruse et al., Illustrated Dict. of Immunology, 2nd ed., CRC Press, 2003, p. 46).*
McGuinness et al. (Mol. Microbiol., 7:505-514, 1993) and Moudallal et al. (EMBO Journal, 1:1005-1010, 1982).*
Moudallal et al. (EMBO Journal, 1:1005-1010, 1982).*
Gardner et al., Nature, Oct. 2002; 419: 498-511.*
STIC Search SEQ ID No. 1 Alignment; Apr. 27, 2010.*
Database UniProt EBI, Hinxton, Cambridgeshire, U.K.; Mar. 1, 2003, Gardner et al. "Hypothetical protein", Database accession No. Q8IJL6.
Database UniProt EBI, Hinxton, Cambridgeshire, U.K.; May 1, 1999, Gardner et al. "Hypothetical protein PFB0540w", Database accession No. O96201.
Database EMBL [Online] Nov. 9, 1998, "*Plasmodium falciparum* 3D7 chromosome 2 section 38 of 73 of the complete sequence", Database accession No. AE001401.
Kemp, D.J. et al. "Genes for antigens of *Plasmodium falciparum*" *Parasitology*, 1986, 91:S83-S108.
Bowman, S. "The complete nucleotide sequence of chromosome 3 of *Plasmodium falciparum*" *Nature*, 1999, 400:532-538.
Carlton, J. "The *Plasmodium vivax* and *P. berghei* gene sequence tag projects" *Parasitology Today*, 2000, 16(10):409.
Dame, J.B. "Current status of the *Plasmodium falciparum* genome project" *Molecular and Biochemical Parasitology*, 1996, 79:1-12.
Gardner, M.J. "Genome sequence of the human malaria parasite *Plasmodium falciparum*" *Nature*, 2002, 419:498-511.
Gardner, M.J. "Chromosome 2 sequence of the human malaria parasite *Plasmodium falciparum*" *Science*, 1998, 282:1126-1132. Database UniProt EBI, Hinxton, Cambridgeshire, U.K.; Jan. 1994, Luo et al. "Several novel membrane-associated plasmodium falciparum antigens cloned by expression in COS cells", Database accession No. Q25778; and alignment display.
Database UniProt EBI, Hinxton, Cambridgeshire, U.K.; May 31, 2006, Long et al. "Telomerase reverse transcriptase (tert) genes" from International Publication No. WO01/27287, sequence 6, Database accession No. AX112154.

* cited by examiner

*Primary Examiner* — Vanessa L. Ford
*Assistant Examiner* — Lakia Tongue
(74) *Attorney, Agent, or Firm* — Saliwanchik, Lloyd & Eisenschenk

(57) ABSTRACT

The subject invention provides novel *Plasmodium falciparum* antigens and novel polynucleotides encoding these antigens. Also provided by the subject invention are methods of using these antigens and polynucleotides.

38 Claims, No Drawings

US 8,017,745 B2

PLASMODIUM FALCIPARUM ANTIGENS AND METHODS OF USE

CROSS-REFERENCE TO RELATED APPLICATIONS

This application is the U.S. national stage application of International Patent Application No. PCT/US2003/038966, filed Dec. 8, 2003, which claims the benefit of priority of U.S. Patent Provisional Application No. 60/431,494, filed Dec. 6, 2002; both applications are incorporated herein by reference in their entireties, including all references, Tables, and nucleic acid and polynucleotide sequences.

The subject invention was made with government support under a research project supported by Grant No. 1 R43AI49051-01 NIAID.

The Sequence Listing for this application is on duplicate compact discs labeled "Copy 1" and "Copy 2." Copy 1 and Copy 2 each contain only one file named "EPI-103X PCT.ST25.txt" which was created on Feb. 24, 2004, and is 566 KB. The entire contents of each of the computer discs are incorporated herein by reference in their entireties.

BACKGROUND OF INVENTION

The recent explosion in genomic sequencing has deposited a wealth of information in the hands of researchers. However, there is not yet a means to efficiently analyze such data to identify which antigens among many thousands are appropriate targets for vaccine development.

More than 5000 proteins are expressed during the life cycle of the *Plasmodium* spp. parasite. Subunit vaccines currently in development are based on a single or few antigens and may therefore, elicit too narrow a breadth of response, providing neither optimal protection nor protection on genetically diverse backgrounds. By contrast, to duplicate the protection induced by whole organism vaccination (Good, M. F. & Doolan, D. L. Immune effector mechanisms in malaria. *Curr. Opin. Immunol.* 11, 412-419 (1999)), a malaria vaccine targeting an unprecedented number of parasite-derived proteins through inclusion of their minimal $CD8^+$ and $CD4^+$ T cell epitopes in a multiepitope construct appears to be required. However, the antigens mediating whole organism induced protection are largely unknown.

Because of various factors, principally related to antigen abundance and immunodominance, not all possible antigens are recognized by natural immunity (Yewdell J W, Bennink J R. Immunodominance in major histocompatibility complex class I-restricted T lymphocyte responses. *Annu. Rev. Immunol.* 17, 51-88. (1999)). Various approaches have been proposed for antigen identification, including expression cloning (Kawakami, Y. & Rosenberg, S. A. Immunobiology of human melanoma antigens MART-1 and gp100 and their use for immuno-gene therapy. *Int. Rev. Immunol.* 14, 173-192 (1997)), elution and mass spectrometry sequencing of naturally processed MHC-bound peptides (Rotzschke, O. et al. Isolation and analysis of naturally processed viral peptides as recognized by cytotoxic T cells. *Nature* 348, 252-254 (1990); van Bleek, G. M. & Nathenson, S. G. Isolation of an endogenously processed immunodominant viral peptide from the class I H-2 Kb molecule. *Nature* 348, 213-216 (1990); Hunt, D. F. et al. Peptides presented to the immune system by the murine class II major histocompatibility complex molecule I-Ad. *Science* 256, 1817-1820 (1992); Cox, A. L. et al. Identification of a peptide recognized by five melanoma-specific human cytotoxic T cell lines. *Science* 264, 716-719 (1994)), in vitro testing of pools of overlapping peptides (Kern, F. et al. Cytomegalovirus (CMV) Phosphoprotein 65 Makes a Large Contribution to Shaping the T Cell Repertoire in CMV-Exposed Individuals. *J. Infect. Dis.* 185, 1709-1716 (2002)), and reverse immunogenetics (Davenport, M. P. & Hill, A. V. Reverse immunogenetics: from HLA-disease associations to vaccine candidates. *Mol. Med. Today* 2, 38-45 (1996); Aidoo, M. et al. Identification of conserved antigenic components for a cytotoxic T lymphocyte-inducing vaccine against malaria. *Lancet* 345, 1003-1007 (1995)). However, these methods suffer from potential problems such as the repeated identification of the same (frequent/dominant) epitope, biases at the level of expansion of T cell populations, and use of clonal/oligoclonal T cells. They also tend to underestimate the complexity of responses, and are not able to analyze a large number of potential targets in the context of multiple HLA types. Finally, none of these approaches easily lends itself towards the daunting task of efficiently analyzing large amounts of genomic sequence data.

BRIEF SUMMARY

The subject invention also provides novel *Plasmodium falciparum* antigens that are useful in therapeutic and diagnostic applications. In various aspects, the subject invention provides embodiments such as:

A) isolated and/or purified polynucleotide sequences comprising:
  a) a polynucleotide sequence encoding a polypeptide sequence selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27;
  b) a complementary polynucleotide sequence to a polynucleotide sequence encoding a polypeptide sequence selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27;
  c) a polynucleotide sequence having at least about 20% to 99.99% identity to a polynucleotide sequence of A(a) or A(b);
  d) a fragment of a polynucleotide sequence according to A(a) or A(b);
  e) a polynucleotide sequence encoding a polypeptide as set forth in Table 2, 3, 4, 5, or 6, or a polynucleotide sequence encoding a polypeptide selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27;
  f) a polynucleotide sequence encoding a variant of a polypeptide (e.g., a variant polypeptide) selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27;
  g) a polynucleotide sequence encoding a polypeptide fragment of a polypeptide selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27, wherein the fragment has substantially the same serologic reactivity as the native polypeptide and/or substantially the same T-cell reactivity as the native polypeptide or fragment;
  h) a polynucleotide sequence encoding a fragment of a variant polypeptide of a polypeptide selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27, wherein the fragment of the variant polypeptide has substantially the same serologic activity as the native polypeptide or substantially the same T-cell reactivity as the native polypeptide or fragment; or
  i) a polynucleotide sequence encoding a multi-epitope construct;
B) primers or detection probes (e.g., fragments of the disclosed polynucleotide sequences) for hybridization with a target sequence or the amplicon generated from the target sequence comprising a sequence of at least 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, or 100 consecutive nucleotides of the polynucleotide sequences set forth herein. Labeled probes or primers are labeled with a radioactive compound or with another type of label as set forth in embodiment C, below;
C) isolated polynucleotides according to embodiments A or B further comprising a label; labels can include, and are not limited to 1) radioactive labels, 2) enzyme labels, 3) chemiluminescent labels, 4) fluorescent labels, 5) magnetic labels, or other suitable labels. Exemplary labels include, and are not limited to, $^{32}P$, $^{35}S$, $^{3}H$, $^{125}I$, biotin, acetylaminofluorene, digoxigenin, 5-bromodeoxyuridine, or fluorescein;
D) methods of detecting P. falciparum in biological samples comprising contacting a biological sample with isolated polynucleotides of embodiments A, B, or C. In this embodiment, P. falciparum cells, or cells comprising (infected) by P. falciparum are recovered, lysed, and DNA and/or RNA are extracted from the lysed cells. The extracted DNA or RNA is then tested using polynucleotides and/or probes set forth herein for the presence of P. falciparum. Typical assay formats utilizing nucleic acid hybridization includes, and are not limited to, 1) nuclear run-on assay, 2) slot blot assay, 3) northern blot assay (Alwine, et al. Proc. Natl. Acad. Sci. 74:5350), 4) magnetic particle separation, 5) nucleic Acid or DNA chips, 6) reverse Northern blot assay, 7) dot blot assay, 8) in situ hybridization, 9) RNase protection assay (Melton, et al. Nuc. Acids Res. 12:7035 and as described in the 1998 catalog of Ambion, Inc., Austin, Tex.), 10) ligase chain reaction, 11) polymerase chain reaction (PCR), 12) reverse transcriptase (RT)-PCR (Berchtold, et al. Nuc. Acids. Res. 17:453), 13) differential display RT-PCR (DDRT-PCR) or other suitable combinations of techniques and assays;
E) analytical systems, such as DNA chips comprising polynucleotide sequences according to embodiments A, B, or C;
F) modified polynucleotide sequences comprising polynucleotide sequences according to embodiments A or B;
G) a polynucleotide sequence according to embodiments A, B, or F, further comprising regulatory sequences, such as promoters, enhancer elements, or termination sequences, that are operably linked to the polynucleotide sequences of embodiments A or B;
H) a vector comprising a promoter operably linked to a nucleic acid sequence of the subject invention (e.g., as set forth in embodiments A, B, or F), optionally, one or more origins of replication, and, optionally, one or more selectable markers (e.g., an antibiotic resistance gene);
I) host cells transformed by a vector according embodiment G or H. The host cell may be chosen from eukaryotic or prokaryotic systems, such as for example bacterial cells, (Grain negative or Gram positive), yeast cells, animal cells (such as Chinese hamster ovary (CHO) cells), plant cells, and/or insect cells using baculovirus vectors. In some embodiments, the host cells for expression of the polypeptides include, and are not limited to, those taught in U.S. Pat. Nos. 6,319,691, 6,277,375, 5,643,570, or 5,565,335, each of which is incorporated by reference in its entirety, including all references cited within each respective patent.
I) novel compositions comprising a pharmaceutically acceptable carrier and a polynucleotide according to embodiments A or B;
J) methods of inducing an immune response or protective immune response in an individual comprising the administration of a composition comprising a polynucleotide according to embodiments A and/or B and a pharmaceutically acceptable carrier in an amount sufficient to induce an immune response;
K) the method according to embodiment J, further comprising the administration of: 1) a viral vector comprising a polynucleotide according to embodiment A and/or B (or composition comprising the viral vector); and/or 2) a polypeptide antigen (or composition thereof) of the invention; in a preferred embodiment, the antigen is the polypeptide that is encoded by the polynucleotide administered as the polynucleotide vaccine. As a particularly preferred embodiment, the polypeptide antigen is administered as a booster subsequent to the initial administration of the polynucleotide vaccine. Exemplary viral vectors suitable for use in this embodiment include, but are not limited to, poxvirus such as vaccinia virus, avipox virus, fowlpox virus, a highly attenuated vaccinia virus (such as Ankara or MVA [Modified Vaccinia Ankara]), retrovirus, adenovirus, baculovirus and the like. In a preferred embodiment, the viral vector is Ankara or MVA;
L) compositions comprising the polynucleotides of embodiments A, B, or F inserted into nucleic acid vaccine vectors (plasmids) or viral vectors and, optionally, a pharmaceutically acceptable carrier, e.g., saline;
M) one or more isolated polypeptides comprising:
  a) a polypeptide encoded by a polynucleotide sequence according to embodiment A(a);
  b) a variant polypeptide encoded by a polynucleotide sequence having at least about 20% to 99.99% identity to a polynucleotide according to embodiment A(a);
  c) a fragment of a polypeptide or a variant polypeptide, wherein said fragment or variant has substantially the same serologic reactivity or substantially the same T-cell reactivity as the native polypeptide (e.g., those polypeptides set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27 and Tables 2, 3, 4, 5 or 6);
  d) a polypeptide sequence provided in Tables 2, 3, 4, 5 or 6 or selected from the group consisting of SEQ ID NO: NO: 1, 2, 3, 4, 5, 6, 7, 8, 9, 10, 11, 12, 13, 14, 15, 16, 17, 18, 19, 20, 21, 22, 23, 24, 25, 26, and 27;
  e) a variant polypeptide having at least about 20% to 99.99% identity to a polypeptide provided in Tables 2, 3, 4, 5 or 6 or selected from the group consisting of SEQ ID NO: NO: 1, 2, 3, 4, 5, 6, 7, 8, 9, 10, 11, 12, 13, 14, 15, 16, 17, 18, 19, 20, 21, 22, 23, 24, 25, 26, and 27;
  f) a polypeptide (epitope) set forth in Table 2, 3, 4, 5 or 6; or
  g) a multi-epitope construct: 1) comprising at least one epitope set forth in Table 2, 3, 4, 5 or 6; 2) comprising a polypeptide selected from the group consisting of SEQ ID NO: NO: 1, 2, 3, 4, 5, 6, 7, 8, 9, 10, 11, 12, 13, 14, 15, 16, 17, 18, 19, 20, 21, 22, 23, 24, 25, 26, and 27 and at least one epitope set forth in Tables 2, 3, 4, 5 and/or 6; or 3) comprising and at least one epitope set forth in Tables 2, 3, 4, 5 and/or 6 and one or more polypeptide selected from the group consisting of SEQ ID NO: NO: 1, 2, 3, 4, 5, 6, 7, 8, 9, 10, 11, 12, 13, 14, 15, 16, 17, 18, 19, 20, 21, 22, 23, 24, 25, 26, and 27;

N) a polypeptide epitope according to embodiment M(f), wherein the polypeptide epitope is a CTL-inducing peptides of about 13 residues or less in length, preferably between about 8 and about 11 residues (e.g., 8, 9, 10 or all residues), and more preferably 9 or 10 residues;

O) a polypeptide epitope according to embodiment M(f), wherein the polypeptide epitope is a HTL-inducing peptide of less than about 50 residues, preferably, between about 6 and about 30 residues, more preferably, between about 12 and 25 residues (e.g., 12, 13, 14, 15, 16, 17, 18, 19, 20, 21, 22, 23, 24, or 25 residues), and most preferably, between about 15 and 20 residues (e.g., 15, 16, 17, 18, 19, or 20 residues);

P) methods for eliciting an immune response in an individual comprising the administration of compositions comprising polypeptides according to embodiment M or N to an individual in amounts sufficient to induce an immune response in the individual;

Q) a composition comprising a pharmaceutically acceptable carrier and a polypeptide according to embodiment M or N, that can, optionally, contain an adjuvant;

R) diagnostic assays based upon Western blot formats, or standard immunoassays known to the skilled artisan, comprising contacting a biological sample obtained from an individual with a polypeptide according to the embodiments M or N and detecting the formation of an antibody-antigen complex or detecting the stimulation of T-cells obtained from the individual (for example, as set forth in the Examples herein);

S) a "multi-epitope construct" comprising: 1) polynucleotides that encode multiple polypeptide epitopes (of any length) that can bind to one or more molecules functioning in the immune system; or 2) polypeptides comprising multiple polypeptide epitopes that can bind to one or more molecules functioning in the immune system. Some embodiments provide for "multi-epitope constructs" that comprise a combination or series of different epitopes, optionally connected by "flanking" residues. "Multi-epitope constructs" can include the full length polypeptides from which the epitopes are obtained (e.g., the polypeptides of SEQ ID NOs: 1-27);

T) a multi-epitope construct according to embodiment S, wherein the epitopes used in the formation of the multi-epitope construct are selected from those set forth in Table 2, Table, 3, Table 4, Table 5, and Table 6;

U) a multi-epitope construct according to embodiments S or T that is of "high affinity" or "intermediate affinity";

V) a multi-epitope construct according to embodiments S, T, or U that comprises five or more, ten or more, fifteen or more, twenty or more, or twenty-five or more epitopes. Other embodiments provide multi-epitope constructs that comprise at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99 epitopes.

W) a multi-epitope construct according to embodiments S, T, U, or V wherein: a) all of the epitopes in a multi-epitope construct are from one organism (e.g., the epitopes are obtained from *P. falciparum*); or b) or the multi-epitope construct includes epitopes present in two or more different organisms (e.g., some epitopes from *P. falciparum* and some epitopes from another organism). Additionally, the same epitope may be present in a multi-epitope construct at more than one location in the construct. In some embodiments, novel epitopes of the subject invention may be linked to known epitopes of an organism (e.g., *P. falciparum* or another organism).

X) a multi-epitope construct according to embodiments S, T, U, V, or W, wherein the individual epitopes interact with an antigen binding site of an antibody molecule or fragment thereof, a class I HLA, a T-cell receptor, and/or a class II HLA molecule.

Y) a multi-epitope construct according to embodiments S, T, U, V, W, or X, wherein the construct further comprises, optionally, 1 to 5 "flanking" or "linking" residues positioned next to one or more epitopes;

Z) a multi-epitope construct according to embodiments S, T, U, V, W, X, or Y that has, optionally, been "optimized";

AA) an isolated antibody or fragment thereof that specifically binds to a polypeptide as set forth in embodiments M or N;

BB) a viral vector comprising a polynucleotide according to embodiment A or B. Exemplary viral vectors suitable for use in this embodiment include, but are not limited to, poxvirus such as vaccinia virus, avipox virus, fowlpox virus, a highly attenuated vaccinia virus (such as Ankara or MVA [Modified Vaccinia Ankara]), retrovirus, adenovirus, baculovirus and the like. In a preferred embodiment, the viral vector is Ankara or MVA; and/or CC) a viral vector according to embodiment BB, wherein the viral vector further comprises nucleic acids encoding immunostimulatory molecules such as IL-1, IL-2, IL-3, IL-4, IL-5, IL-6, IL-7, IL-8, IL-9, IL-10, IL-11, IL-15, Il-16, Il-18, IL-23, IL-24, erythropoietin, G-CSF, M-CSF, platelet derived growth factor (PDGF), MSF, FLT-3 ligand, EGF, fibroblast growth factor (FGF; e.g., aFGF (FGF-1), bFGF (FGF-2), FGF-3, FGF4, FGF-5, FGF-6, or FGF-7), insulin-like growth factors (e.g., IGF-1, IGF-2); vascular endothelial growth factor (VEGF); interferons (e.g., IFN-γ, IFN-α, IFN-β); leukemia inhibitory factor (LIF); ciliary neurotrophic factor (CNTF); oncostatin M; stem cell factor (SCF); transforming growth factors (e.g., TGF-α, TGF-β1, TGF-β1, TGF-β1), or chemokines (such as, but not limited to, BCA-1/BLC-1, BRAK/Kec, CXCL16, CXCR3, ENA-78/LIX, Eotaxin-1, Eotaxin-2/MPIF-2, Exodus-2/SLC, Fractalkine/Neur7otactin, GROalpha/MGSA, HCC-1, I-TAC, Lymphotactin/ATAC/SCM, MCP-1/MCAF, MCP-3, MCP4, MDC/STCP-1, ABCD-1, MIP-1α, MIP-1β, MIP-2α/GROβ, MIP-3α/Exodus/LARC, MIP-3β/Exodus-3/ELC, MIP-4/PARC/DC-CK1, PF-4, RANTES, SDF1α, TARC, or TECK).

BRIEF DESCRIPTION OF DRAWINGS AND TABLES

Table 1 presents a summary of immune reactivities of a panel of 27 novel antigens and four known antigens.

Tables 2-6 provide peptide epitopes of *P. falciparum*.

BRIEF DESCRIPTION OF SEQUENCES

Sequence ID NOs: 1-27 are amino acid sequences of novel malaria antigens.

DETAILED DISCLOSURE

The subject invention provides isolated and/or purified novel *P. falciparum* polynucleotides and fragments of these novel polynucleotides. Thus, the present invention provides isolated and/or purified polynucleotide sequences comprising:
- a) a polynucleotide sequence encoding a polypeptide sequence selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27;
- b) a complementary polynucleotide sequence to a polynucleotide sequence encoding a polypeptide sequence selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27;
- c) a polynucleotide sequence having at least about 20% to 99.99% identity to a polynucleotide sequence of (a) or (b);
- d) a fragment of a polynucleotide sequence according to (a) or (b);
- e) a polynucleotide sequence encoding a polypeptide as set forth in Table 2, 3, 4, 5 or 6 or a polynucleotide sequence encoding a polypeptide selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27;
- f) a polynucleotide sequence encoding variant of a polypeptide (e.g., a variant polypeptide) selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27;
- g) a polynucleotide sequence encoding a polypeptide fragment of a polypeptide selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27, wherein the fragment has substantially the same serologic reactivity as the native polypeptide or substantially the same T-cell reactivity as the native polypeptide or fragment;
- h) a polynucleotide sequence encoding a fragment of a variant polypeptide of a polypeptide selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27, wherein the fragment of the variant polypeptide has substantially the same serologic activity as the native polypeptide or substantially the same T-cell reactivity as the native polypeptide or fragment; or
- i) a polynucleotide sequence encoding a multi-epitope construct.

"Nucleotide sequence", "polynucleotide" or "nucleic acid" can be used interchangeably and are understood to mean, according to the present invention, either a double-stranded DNA, a single-stranded DNA or products of transcription of the said DNAs (e.g., RNA molecules). It should also be understood that the present invention does not relate to genomic polynucleotide sequences of *P. falciparum* in their natural environment or natural state. The nucleic acid, polynucleotide, or nucleotide sequences of the invention have been isolated, purified (or partially purified), by separation methods including, but not limited to, ion-exchange chromatography, molecular size exclusion chromatography, affinity chromatography, or by genetic engineering methods such as amplification, cloning, subcloning or chemical synthesis.

A homologous polynucleotide or polypeptide sequence, for the purposes of the present invention, encompasses a sequence having a percentage identity with the polynucleotide or polypeptide sequences, set forth herein, of between at least (or at least about) 20.00% to 99.99% (inclusive). The aforementioned range of percent identity is to be taken as including, and providing written description and support for, any fractional percentage, in intervals of 0.01%, between 20.00% and, up to, including 99.99%. These percentages are purely statistical and differences between two nucleic acid sequences can be distributed randomly and over the entire sequence length.

In various embodiments, homologous sequences can exhibit a percent identity of 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99 percent with the sequences of the instant invention. Typically, the percent identity is calculated with reference to the full length, native, and/or naturally occurring polypeptide or polynucleotide (e.g., those polypeptides set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27 or those set forth in SEQ ID NOs:28-81)). The terms "identical" or percent "identity", in the context of two or more polynucleotide or polypeptide sequences, refer to two or more sequences or subsequences that are the same or have a specified percentage of amino acid residues that are the same, when compared and aligned for maximum correspondence over a comparison window, as measured using a sequence comparison algorithm or by manual alignment and visual inspection. Preferably, such a substitution is made in accordance with analoging principles set forth, e.g., in co-pending U.S. Ser. No. 09/260,714 filed Mar. 1, 1999 and U.S. Ser. No. 09/226,775, filed Jan. 6, 1999 and PCT application number PCT/US00/19774 each of which is hereby incorporated by reference in its entirety.

Both protein and nucleic acid sequence homologies may be evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, 1988, *Proc. Natl. Acad. Sci. USA* 85(8):2444-2448; Altschul et al., 1990, *J. Mol. Biol.* 215(3):403-410; Thompson et al., 1994, *Nucleic Acids Res.* 22(2):4673-4680; Higgins et al., 1996, *Methods Enzymol.* 266:383-402; Altschul et al., 1990, *J. Mol. Biol.* 215(3):403-410; Altschul et al, 1993, *Nature Genetics* 3:266-272). Sequence comparisons are, typically, conducted using default parameters provided by the vendor or using those parameters set forth in the above-identified references, which are hereby incorporated by reference in their entireties.

A "complementary" polynucleotide sequence, as used herein, generally refers to a sequence arising from the hydrogen bonding between a particular purine and a particular pyrimidine in double-stranded nucleic acid molecules (DNA-DNA, DNA-RNA, or RNA-RNA). The major specific pairings are guanine with cytosine and adenine with thymine or uracil. A "complementary" polynucleotide sequence may also be referred to as an "antisense" polynucleotide sequence or an "antisense" sequence.

Sequence homology and sequence identity can also be determined by hybridization studies under high stringency, intermediate stringency, and/or low stringency. Various degrees of stringency of hybridization can be employed. The more severe the conditions, the greater the complementarity that is required for duplex formation. Severity of conditions can be controlled by temperature, probe concentration, probe length, ionic strength, time, and the like. Preferably, hybridization is conducted under low, intermediate, or high stringency conditions by techniques well known in the art, as described, for example, in Keller, G. H., M. M. Manak [1987] *DNA Probes*, Stockton Press, New York, N.Y., pp. 169-170.

For example, hybridization of immobilized DNA on Southern blots with $^{32}$P-labeled gene-specific probes can be performed by standard methods (Maniatis et al. [1982] *Molecular Cloning: A Laboratory Manual*, Cold Spring Harbor Laboratory, New York). In general, hybridization and subsequent washes can be carried out under intermediate to high stringency conditions that allow for detection of target sequences with homology to the exemplified polynucleotide sequence. For double-stranded DNA gene probes, hybridization can be carried out overnight at 20-25° C. below the melting temperature ($T_m$) of the DNA hybrid in 6×SSPE, 5×Denhardt's solution, 0.1% SDS, 0.1 mg/ml denatured DNA. The melting temperature is described by the following formula (Beltz et al. [1983] *Methods of Enzymology*, R. Wu, L. Grossman and K. Moldave [eds.] Academic Press, New York 100:266-285).

$Tm=81.5°$ C.$+16.6$ Log $[Na^+]+0.41$ (% G+C)$-0.61$(% formamide)$-600$/length of duplex in base pairs.

Washes are typically carried out as follows:
(1) twice at room temperature for 15 minutes in 1×SSPE, 0.1% SDS (low stringency wash);
(2) once at $T_m-20°$ C. for 15 minutes in 0.2×SSPE, 0.1% SDS (intermediate stringency wash).

For oligonucleotide probes, hybridization can be carried out overnight at 10-20° C. below the melting temperature ($T_m$) of the hybrid in 6×SSPE, 5×Denhardt's solution, 0.1% SDS, 0.1 mg/ml denatured DNA. $T_m$ for oligonucleotide probes can be determined by the following formula:

$T_m$ (° C.)$=2$(number T/A base pairs)$+4$(number G/C base pairs) (Suggs et al. [1981] *ICN-UCLA Symp. Dev. Biol. Using Purified Genes*, D. D. Brown [ed.], Academic Press, New York, 23:683-693).

Washes can be carried out as follows:
(1) twice at room temperature for 15 minutes 1×SSPE, 0.1% SDS (low stringency wash);
2) once at the hybridization temperature for 15 minutes in 1×SSPE, 0.1% SDS (intermediate stringency wash).

In general, salt and/or temperature can be altered to change stringency. With a labeled DNA fragment >70 or so bases in length, the following conditions can be used:

| | |
|---|---|
| Low: | 1 or 2X SSPE, room temperature |
| Low: | 1 or 2X SSPE, 42° C. |
| Intermediate: | 0.2X or 1X SSPE, 65° C. |
| High: | 0.1X SSPE, 65° C. |

By way of another non-limiting example, procedures using conditions of high stringency can also be performed as follows: Pre-hybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65° C., the preferred hybridization temperature, in pre-hybridization mixture containing 100 µg/ml denatured salmon sperm DNA and 5-20×10$^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. Other conditions of high stringency which may be used are well known in the art and as cited in Sambrook et al., 1989, Molecular Cloning, A Laboratory Manual, Second Edition, Cold Spring Harbor Press, N.Y., pp. 9.47-9.57; and Ausubel et al., 1989, Current Protocols in Molecular Biology, Green Publishing Associates and Wiley Interscience, N.Y. are incorporated herein in their entirety.

Another non-limiting example of procedures using conditions of intermediate stringency are as follows: Filters containing DNA are pre-hybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of intermediate stringency which may be used are well known in the art and as cited in Sambrook et al., 1989, Molecular Cloning, A Laboratory Manual, Second Edition, Cold Spring Harbor Press, N.Y., pp. 9.47-9.57; and Ausubel et al., 1989, Current Protocols in Molecular Biology, Green Publishing Associates and Wiley Interscience, N.Y. are incorporated herein in their entirety.

Duplex formation and stability depend on substantial complementarity between the two strands of a hybrid and, as noted above, a certain degree of mismatch can be tolerated. Therefore, the probe sequences of the subject invention include mutations (both single and multiple), deletions, insertions of the described sequences, and combinations thereof, wherein said mutations, insertions and deletions permit formation of stable hybrids with the target polynucleotide of interest. Mutations, insertions and deletions can be produced in a given polynucleotide sequence in many ways, and these methods are known to an ordinarily skilled artisan. Other methods may become known in the future.

It is also well known in the art that restriction enzymes can be used to obtain functional fragments of the subject DNA sequences. For example, Bal31 exonuclease can be conveniently used for time-controlled limited digestion of DNA (commonly referred to as "erase-a-base" procedures). See, for example, Maniatis et al. [1982] *Molecular Cloning: A Laboratory Manual*, Cold Spring Harbor Laboratory, New York; Wei et al. [1983] *J. Biol. Chem.* 258:13006-13512.

The present invention further comprises fragments of the polynucleotide sequences of the instant invention. Representative fragments of the polynucleotide sequences according to the invention will be understood to mean any nucleotide fragment having at least 8 successive nucleotides, preferably at least 12 successive nucleotides, and still more preferably at least 15 or at least 20 successive nucleotides of the sequence from which it is derived. The upper limit for such fragments is the total number of polynucleotides found in the full length sequence (or, in certain embodiments, of the full length open reading frame (ORF) identified herein).

In some embodiments, the subject invention includes those fragments capable of hybridizing under various conditions of stringency conditions (e.g., high or intermediate or low stringency) with a nucleotide sequence according to the invention;

fragments that hybridize with a nucleotide sequence of the subject invention can be, optionally, labeled as set forth below.

Other embodiments provide for nucleic acid fragments corresponding to nucleotide sequences comprising full, or partial, open reading frames (ORF sequences). Also within the scope of the invention are those polynucleotide fragments encoding polypeptides reactive with antibodies found in the serum of individuals infected with P. falciparum. Fragments according to the subject invention can be obtained, for example, by specific amplification (e.g., PCR amplification), digestion with restriction enzymes, of nucleotide sequences according to the invention. Such methodologies are well-known in the art and are taught, for example, by Sambrook et al., 1989. Nucleic acid fragments according to the invention can also be obtained by chemical synthesis according to methods well known to persons skilled in the art.

The subject invention also provides nucleic acid based methods for the identification of the presence of an organism in a sample. In these varied embodiments, the invention provides for the detection of nucleic acids in a sample comprising contacting a sample with a nucleic acid (polynucleotide) of the subject invention (such as an RNA, mRNA, DNA, cDNA, or other nucleic acid). In a preferred embodiment, the polynucleotide is a probe that is, optionally, labeled and used in the detection system. Many methods for detection of nucleic acids exist and any suitable method for detection is encompassed by the instant invention. Typical assay formats utilizing nucleic acid hybridization includes, and are not limited to, 1) nuclear run-on assay, 2) slot blot assay, 3) northern blot assay (Alwine, et al. Proc. Natl. Acad. Sci. 74:5350), 4) magnetic particle separation, 5) nucleic Acid or DNA chips, 6) reverse Northern blot assay, 7) dot blot assay, 8) in situ hybridization, 9) RNase protection assay (Melton, et al. Nuc. Acids Res. 12:7035 and as described in the 1998 catalog of Ambion, Inc., Austin, Tex.), 10) ligase chain reaction, 11) polymerase chain reaction (PCR), 12) reverse transcriptase (RT)-PCR (Berchtold, et al., Nuc. Acids. Res. 17:453), 13) differential display RT-PCR (DDRT-PCR) or other suitable combinations of techniques and assays. Labels suitable for use in these detection methodologies include, and are not limited to 1) radioactive labels, 2) enzyme labels, 3) chemiluminescent labels, 4) fluorescent labels, 5) magnetic labels, or other suitable labels, including those set forth below. These methodologies and labels are well known in the art and widely available to the skilled artisan. Likewise, methods of incorporating labels into the nucleic acids are also well known to the skilled artisan.

Thus, the subject invention also provides detection probes (e.g., fragments of the disclosed polynucleotide sequences) for hybridization with a target sequence or the amplicon generated from the target sequence. Such a detection probe will advantageously have as sequence a sequence of at least 8, 9, 10, 11, 12, 15, 16, 17, 18, 19, 20, 21, 22, 23, 24, 25, 26, 27, 28, 29, 30, 35, 40, 45, 50, 55, 60, 65, 70, 75, 80, 85, 90, 95, or 100 nucleotides. Labeled probes or primers are labeled with a radioactive compound or with another type of label as set forth above. Alternatively, non-labeled nucleotide sequences may be used directly as probes or primers; however, the sequences are generally labeled with a radioactive element ($^{32}$P, $^{35}$S, $^{3}$H, $^{125}$I) or with a molecule such as biotin, acetylaminofluorene, digoxigenin, 5-bromo-deoxyuridine, or fluorescein to provide probes that can be used in numerous applications.

The polynucleotide sequences according to the invention may also be used in analytical systems, such as DNA chips. DNA chips and their uses are well known in the art and (see for example, U.S. Pat. Nos. 5,561,071; 5,753,439; 6,214,545; Schena et al., BioEssays, 1996, 18:427-431; Bianchi et al., Clin. Diagn. Virol., 1997, 8:199-208; each of which is hereby incorporated by reference in their entireties) and/or are provided by commercial vendors such as Affymetrix, Inc. (Santa Clara, Calif.). In addition, the nucleic acid sequences of the subject invention can be used as molecular weight markers in nucleic acid analysis procedures.

The subject invention also provides for modified nucleotide sequences. Modified nucleic acid sequences will be understood to mean any nucleotide sequence that has been modified, according to techniques well known to persons skilled in the art, and exhibiting modifications in relation to the native, naturally occurring nucleotide sequences. One non-limiting example of a "modified" nucleotide sequences includes mutations in regulatory and/or promoter sequences of a polynucleotide sequence that result in a modification of the level of expression of the polypeptide. A "modified" nucleotide sequence will also be understood to mean any nucleotide sequence encoding a "modified" polypeptide as defined below.

Another aspect of the invention provides vectors for the cloning and/or the expression of a polynucleotide sequence taught herein. Vectors of this invention, including vaccine vectors, can also comprise elements necessary to allow the expression and/or the secretion of the said nucleotide sequences in a given host cell. The vector can contain a promoter, signals for initiation and for termination of translation, as well as appropriate regions for regulation of transcription. In certain embodiments, the vectors can be stably maintained in the host cell and can, optionally, contain signal sequences directing the secretion of translated protein. These different elements are chosen according to the host cell used. Vectors can integrate into the host genome or, optionally, be autonomously-replicating vectors.

The subject invention also provides for the expression of a polypeptide, peptide, derivative, or variant encoded by a polynucleotide sequence disclosed herein comprising the culture of an organism transformed with a polynucleotide of the subject invention under conditions that allow for the expression of the polypeptide, peptide, derivative, or analog and, optionally, recovering the expressed polypeptide, peptide, derivative, or analog.

The disclosed polynucleotide sequences can also be regulated by a second nucleic acid sequence so that the protein or peptide is expressed in a host transformed with the recombinant DNA molecule. For example, expression of a protein or peptide may be controlled by any promoter/enhancer element known in the art. Promoters which may be used to control expression include, but are not limited to, the CMV-IE promoter, the SV40 early promoter region (Bernoist and Chambon, 1981, Nature 290:304-310), the promoter contained in the 3' long terminal repeat of Rous sarcoma virus (Yamamoto, et al., 1980, Cell 22:787-797), the herpes simplex thymidine kinase promoter (Wagner et al., 1981, Proc. Natl. Acad. Sci. U.S.A. 78:1441-1445), the regulatory sequences of the metallothionein gene (Brinster et al., 1982, Nature 296:3942); prokaryotic vectors containing promoters such as the β-lactamase promoter (Villa-Kamaroff, et al., 1978, Proc. Natl. Acad. Sci. U.S.A. 75:3727-3731), or the tac promoter (DeBoer, et al., 1983, Proc. Natl. Acad. Sci. U.S.A. 80:21-25); see also "Useful proteins from recombinant bacteria" in Scientific American, 1980, 242:74-94; plant expression vectors comprising the nopaline synthetase promoter region (Herrera-Estrella et al., 1983, Nature 303:209-213) or the cauliflower mosaic virus 35S RNA promoter (Gardner, et al., 1981, Nucl. Acids Res. 9:2871), and the promoter of the photosynthetic enzyme ribulose biphosphate carboxylase (Herrera-Estrella et al., 1984, Nature 310:115-120); promoter elements from yeast or fungi such as the Gal 4 promoter, the ADC (alcohol dehydrogenase) promoter, PGK (phosphoglycerol kinase) promoter, and/or the alkaline phosphatase promoter.

The vectors according to the invention are, for example, vectors of plasmid or viral origin. In a specific embodiment, a vector is used that comprises a promoter operably linked to a protein or peptide-encoding nucleic acid sequence contained within the disclosed polynucleotide sequences, one or more origins of replication, and, optionally, one or more selectable markers (e.g., an antibiotic resistance gene). Expression vectors comprise regulatory sequences that control gene expression, including gene expression in a desired host cell. Exemplary vectors for the expression of the polypeptides of the invention include the pET-type plasmid vectors (Promega) or pBAD plasmid vectors (Invitrogen) or those provided in the examples below. Furthermore, the vectors according to the invention are useful for transforming host cells so as to clone or express the polynucleotide sequences of the invention.

The invention also encompasses the host cells transformed by a vector according to the invention. These cells may be obtained by introducing into host cells a nucleotide sequence inserted into a vector as defined above, and then culturing the said cells under conditions allowing the replication and/or the expression of the polynucleotide sequences of the subject invention.

The host cell may be chosen from eukaryotic or prokaryotic systems, such as for example bacterial cells, (Gram negative or Gram positive), yeast cells (for example, *Saccharomyces cereviseae* or *Pichia pastoris*), animal cells (such as Chinese hamster ovary (CHO) cells), plant cells, and/or insect cells using baculovirus vectors. In some embodiments, the host cells for expression of the polypeptides include, and are not limited to, those taught in U.S. Pat. Nos. 6,319,691, 6,277,375, 5,643,570, or 5,565,335, each of which is incorporated by reference in its entirety, including all references cited within each respective patent.

Furthermore, a host cell strain may be chosen which modulates the expression of the inserted sequences, or modifies and processes the gene product in the specific fashion desired. Expression from certain promoters can be elevated in the presence of certain inducers; thus, expression of the genetically engineered polypeptide may be controlled. Furthermore, different host cells have characteristic and specific mechanisms for the translational and post-translational processing and modification (e.g., glycosylation, phosphorylation) of proteins. Appropriate cell lines or host systems can be chosen to ensure the desired modification and processing of the foreign protein expressed. For example, expression in a bacterial system can be used to produce an unglycosylated core protein product. Expression in yeast will produce a glycosylated product. Expression in mammalian cells can be used to ensure "native" glycosylation of a heterologous protein. Furthermore, different vector/host expression systems may effect processing reactions to different extents.

The subject invention also concerns novel compositions that can be employed to elicit an immune response or a protective immune response. In this aspect of the invention, an amount of a composition comprising recombinant DNA or mRNA encoding an polynucleotide of the subject invention sufficient to elicit an immune response or protective immune response is administered to an individual. Signal sequences may be deleted from the nucleic acid encoding an antigen of interest and the individual may be monitored for the induction of an immune response according to methods known in the art. A "protective immune response" or "therapeutic immune response" refers to a CTL (or CD8$^+$ T cell) and/or an HTL (or CD4$^+$ T cell) response to an antigen that, in some way, prevents or at least partially arrests disease symptoms, side effects or progression. The immune response may also include an antibody response that has been facilitated by the stimulation of helper T cells.

In another embodiment, the subject invention further comprises the administration of polynucleotide vaccines in conjunction with a polypeptide antigen, or composition thereof, of the invention. In a preferred embodiment, the antigen is the polypeptide that is encoded by the polynucleotide administered as the polynucleotide vaccine. As a particularly preferred embodiment, the polypeptide antigen is administered as a booster subsequent to the initial administration of the polynucleotide vaccine.

A further embodiment of the subject invention provides for the induction of an immune response to the novel *Plasmodium falciparum* antigens disclosed herein (see, for example, the antigens and peptides set forth in the Tables and Sequence Listing attached hereto) using a "prime-boost" vaccination regimen known to those skilled in the art. In this aspect of the invention, a DNA vaccine is administered to an individual in an amount sufficient to "prime" the immune response of the individual, provided that the DNA vaccine comprises nucleic acids encoding the antigens, multi-epitope constructs, and/or peptide antigens set forth herein. The immune response of the individual is then "boosted" via the administration of: 1) one or a combination of: a peptide, polypeptide, and/or full length polypeptide antigen (e.g., SEQ ID NOs: 1-27) of the subject invention (optionally in conjunction with a immunostimulatory molecule and/or an adjuvant); or 2) a viral vector that contains nucleic acid encoding one, or more, of the same or, optionally, different, antigens, multi-epitope constructs, and/or peptide antigens set forth in the Tables or Sequence Listing of the subject application. In some alternative embodiments of the invention, a gene encoding an immunostimulatory molecule may be incorporated into the viral vector used to "boost the immune response of the individual. Exemplary immunostimulatory molecules include, and are not limited to, IL-1, IL-2, IL-3, IL-4, IL-5, IL-6, IL-7, IL-8, IL-9, IL-10, IL-11, IL-15, Il-16, Il-18, IL-23, IL-24, erythropoietin, G-CSF, M-CSF, platelet derived growth factor (PDGF), MSF, FLT-3 ligand, EGF, fibroblast growth factor (FGF; e.g., aFGF (FGF-1), bFGF (FGF-2), FGF-3, FGF-4, FGF-5, FGF-6, or FGF-7), insulin-like growth factors (e.g., IGF-1, IGF-2); vascular endothelial growth factor (VEGF); interferons (e.g., IFN-γ, IFN-α, IFN-β); leukemia inhibitory factor (LIF); ciliary neurotrophic factor (CNTF); oncostatin M; stem cell factor (SCF); transforming growth factors (e.g., TGF-α, TGF-β1, TGF-β1, TGF-β1), or chemokines (such as, but not limited to, BCA-1/BLC-1, BRAK/Kec, CXCL16, CXCR3, ENA-78/LIX, Eotaxin-1, Eotaxin-2/MPIF-2, Exodus-2/SLC, Fractalkine/Neurotactin, GROalpha/MGSA, HCC-1, I-TAC, Lymphotactin/ATAC/SCM, MCP-1/MCAF, MCP-3, MCP-4, MDC/STCP-1, ABCD-1, MIP-1α, MIP-1β, MIP-2α/GROβ, MIP-3α/Exodus/LARC, MIP-3β/Exodus-3/ELC, MIP4/PARC/DC-CK1, PF-4, RANTES, SDF1α, TARC, or TECK). Genes encoding these immunostimulatory molecules are known to those skilled in the art and coding sequences may be obtained from a variety of sources, including various patents databases, publicly available databases (such as the nucleic acid and protein databases found at the National Library of Medicine or the European Molecular Biology Laboratory), the scientific literature, or scientific literature cited in catalogs produced by companies such as Genzyme, Inc., R&D Systems, Inc, or InvivoGen, Inc. [see, for example, the 1995 Cytokine Research Products catalog, Genzyme Diagnostics, Genzyme Corporation, Cambridge Mass.; 2002 or 1995 Catalog of R&D Systems, Inc (Minneapolis, Minn.); or 2002 Catalog of InvivoGen, Inc (San Diego, Calif.) each of which is incorporated by reference in its entirety, including all references cited therein].

Methods of introducing DNA vaccines into individuals are well-known to the skilled artisan. For example, DNA can be injected into skeletal muscle or other somatic tissues (e.g., intramuscular injection). Cationic liposomes or biolistic devices, such as a gene gun, can be used to deliver DNA vaccines. Alternatively, iontophoresis and other means for transdermal transmission can be used for the introduction of DNA vaccines into an individual.

Viral vectors for use in the subject invention can have a portion of the viral genome deleted to introduce new genes without destroying infectivity of the virus. The viral vector of the present invention is, typically, a non-pathogenic virus. At the option of the practitioner, the viral vector can be selected so as to infect a specific cell type, such as professional antigen presenting cells (e.g., macrophage or dendritic cells). Alternatively, a viral vector can be selected that is able to infect any cell in the individual. Exemplary viral vectors suitable for use in the present invention include, but are not limited to poxvirus such as vaccinia virus, avipox virus, fowlpox virus, a highly attenuated vaccinia virus (such as Ankara or MVA [Modified Vaccinia Ankara]), retrovirus, adenovirus, baculovirus and the like. In a preferred embodiment, the viral vector is Ankara or MVA.

General strategies for construction of vaccinia virus expression vectors are known in the art (see, for example, Smith and Moss Bio Techniques November/December, 306-312, 1984; U.S. Pat. No. 4,738,846 (hereby incorporated by reference in its entirety). Sutter and Moss (Proc. Nat'l. Acad. Sci U.S.A. 89:10847-10851, 1992) and Sutter et al. (Vaccine, 12(11):103240, 1994) disclose the construction and use as a vector, a non-replicating recombinant Ankara virus (MVA) which can be used as a viral vector in the present invention. Other versions of the Modified Vaccinia Ankara strain can also be used in the practice of the subject invention (such as the MVA-BN strain produced by Bavarian Nordic S/A (Copenhagen, Denmark).

Compositions comprising the subject polynucleotides can include appropriate nucleic acid vaccine vectors (plasmids), which are commercially available (e.g., Vical, San Diego, Calif.) or other nucleic acid vectors (plasmids), which are also commercially available (e.g., Valenti, Burlingame, Calif.). Alternatively, compositions comprising viral vectors and polynucleotides according to the subject invention are provided by the subject invention. In addition, the compositions can include a pharmaceutically acceptable carrier, e.g., saline. The pharmaceutically acceptable carriers are well known in the art and also are commercially available. For example, such acceptable carriers are described in E. W. Martin's *Remington's Pharmaceutical Science*, Mack Publishing Company, Easton, Pa.

The subject invention also provides one or more isolated polypeptides comprising:
  a) a polypeptide encoded by a polynucleotide sequence according to embodiment A(a) (set forth above);
  b) a variant polypeptide encoded by a polynucleotide sequence having at least about 20% to 99.99% identity to a polynucleotide according to embodiment A(a) (as set forth above);
  c) a fragment of a polypeptide or a variant polypeptide, wherein said fragment or variant has substantially the same serologic reactivity or substantially the same T-cell reactivity as the native polypeptide (e.g., those polypeptides set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27 and Table 2, 3, 4, 5 or 6);
  d) a polypeptide sequence provided in Table 2, 3, 4, 5 or 6 or selected from the group consisting of SEQ ID NO: NO: 1, 2, 3, 4, 5, 6, 7, 8, 9, 10, 11, 12, 13, 14, 15, 16, 17, 18, 19, 20, 21, 22, 23, 24, 25, 26, and 27;
  e) a variant polypeptide having at least about 20% to 99.99% identity to a polypeptide provided in Table 2, 3, 4, 5 or 6 or selected from the group consisting of SEQ ID NO: NO: 1, 2, 3, 4, 5, 6, 7, 8, 9, 10, 11, 12, 13, 14, 15, 16, 17, 18, 19, 20, 21, 22, 23, 24, 25, 26, and 27;
  f) a polypeptide (epitope) set forth in Table 2, 3, 4, 5 or 6; or
  g) a multi-epitope construct: 1) comprising at least one epitope set forth in Table 2, 3, 4, 5 or 6; 2) comprising a polypeptide selected from the group consisting of SEQ ID NO: NO: 1, 2, 3, 4, 5, 6, 7, 8, 9, 10, 11, 12, 13, 14, 15, 16, 17, 18, 19, 20, 21, 22, 23, 24, 25, 26, and 27 and at least one epitope set forth in Tables 2, 3, 4, 5 or 6; or 3) comprising and at least one epitope set forth in Tables 2, 3, 4, 5 or 6 and one or more polypeptide selected from the group consisting of SEQ ID NO: NO: 1, 2, 3, 4, 5, 6, 7, 8, 9, 10, 11, 12, 13, 14, 15, 16, 17, 18, 19, 20, 21, 22, 23, 24, 25, 26, and 27.

The term "peptide" may be used interchangeably with "oligopeptide" or "polypeptide" or "epitope" in the present specification to designate a series of residues, typically L-amino acids, connected one to the other, typically by peptide bonds between the α-amino and carboxyl groups of adjacent amino acids. The preferred CTL (or $CD8^+$ T cell)-inducing peptides of the invention are 13 residues or less in length and usually consist of between about 8 and about 11 residues (e.g., 8, 9, 10 or 11 residues), preferably 9 or 10 residues. The preferred HTL (or $CD4^+$ T cell)-inducing peptides are less than about 50 residues in length and usually consist of between about 6 and about 30 residues, more usually between about 12 and 25 (e.g., 12, 13, 14, 15, 16, 17, 18, 19, 20, 21, 22, 23, 24 or 25), and often between about 15 and 20 residues (e.g., 15, 16, 17, 18, 19 or 20).

According to the subject invention, a "fragment" is a polypeptide of at least 3 consecutive, preferably 4 consecutive, and even more preferably 5 consecutive amino acids. In some embodiments, the polypeptide fragments are reactive with antibodies found in the serum of an individual. In other embodiments, a fragment is an "epitope" as described supra. In the context of the instant invention, the terms polypeptide, peptide and protein can be used interchangeably; however, it should be understood that the invention does not relate to the polypeptides in natural form, that is to say that they are not in their natural environment but that the polypeptides may have been isolated or obtained by purification from natural sources, obtained from host cells prepared by genetic manipulation (e.g., the polypeptides, or fragments thereof, are recombinantly produced by host cells, or by chemical synthesis). Polypeptides according to the instant invention may also contain non-natural amino acids, as will be described below.

A "variant" or "modified" polypeptide (or polypeptide variant) is to be understood to designate polypeptides exhibiting, in relation to the natural polypeptide, certain modifications. These modifications can include a deletion, addition, or substitution of at least one amino acid, a truncation, an extension, a chimeric fusion, a mutation, or polypeptides exhibiting post-translational modifications. Among the homologous polypeptides, those whose amino acid sequences exhibit between at least (or at least about) 20.00% to 99.99% (inclusive) identity to the full length, native, or naturally occurring polypeptide are another aspect of the invention. The aforementioned range of percent identity is to be taken as including, and providing written description and support for, any fractional percentage, in intervals of 0.01%, between 20.00% and, up to, including 99.99%. These percentages are purely statistical and differences between two polypeptide sequences can be distributed randomly and over the entire sequence length.

Variant peptides (epitopes) can also be created by altering the presence or absence of particular residues in these primary anchor positions. Such analogs are used to modulate the binding affinity of a peptide comprising a particular motif or supermotif. The term "motif" refers to the pattern of residues in a peptide of defined length, usually a peptide of from about 8 to about 13 amino acids for a class I HLA motif (e.g., 8, 9, 10, 11, 12 or 13 aa) and from about 6 to about 25 amino acids for a class II HLA motif (e.g., 6, 7, 8, 9, 10, 11, 12, 13, 14, 15, 16, 17, 18, 19, 20, 21, 22, 23, 24 or 25 amino acids), which is recognized by a particular HLA molecule. Peptide motifs are typically different for each protein encoded by each human HLA allele and differ in the pattern of the primary and secondary anchor residues. Optionally, variant peptides or polypeptides can also comprise one or more heterologous polypeptide sequences (e.g., tags that facilitate purification of the polypeptides of the invention (see, for example, U.S. Pat. No. 6,342,362, hereby incorporated by reference in its entirety; Altendorf et al. [1999-WWW, 2000] "Structure and Function of the $F_0$ Complex of the ATP Synthase from *Escherichia Coli*," *J. of Experimental Biology* 203:19-28, The Co. of Biologists, Ltd., G. B.; Baneyx [1999] "Recombinant Protein Expression in *Escherichia coli*," Biotechnology 10:411-21, Elsevier Science Ltd.; Eihauer et al. [2001] "The FLAG™ Peptide, a Versatile Fusion Tag for the Purification of Recombinant Proteins," *J. Biochem Biophys Methods* 49:455-65; Jones et al. [1995] *J. Chromatography* 707: 3-22; Jones et al. [1995] "Current Trends in Molecular Recognition and Bioseparation," *J. of Chromatography A.* 707:3-22, Elsevier Science B. V.; Margolin [2000] "Green Fluorescent Protein as a Reporter for Macromolecular Localization in Bacterial Cells," *Methods* 20:62-72, Academic Press; Puig et al. [2001] "The Tandem Affinity Purification (TAP) Method: A General Procedure of Protein Complex Purification," *Methods* 24:218-29, Academic Press; Sassenfeld [1990] "Engineering Proteins for Purification," TibTech 8:88-93; Sheibani [1999] "Prokaryotic Gene Fusion Expression Systems and Their Use in Structural and Functional Studies of Proteins," *Prep. Biochem. & Biotechnol.* 29(1):77-90, Marcel Dekker, Inc.; Skerra et al [1999] "Applications of a Peptide Ligand for Streptavidin: the Strep-tag", *Biomolecular Engineering* 16:79-86, Elsevier Science, B. V.; Smith [1998] "Cookbook for Eukaryotic Protein Expression: Yeast, Insect, and Plant Expression Systems," *The Scientist* 12(22): 20; Smyth et al [2000] "Eukaryotic Expression and Purification of Recombinant Extracellular Matrix Proteins Carrying the Strep II Tag", *Methods in Molecular Biology,* 139:49-57; Unger [1997] "Show Me the Money: Prokaryotic Expression Vectors and Purification Systems," *The Scientist* 11(17):20, each of which is hereby incorporated by reference in their entireties), or commercially available tags from vendors such as such as STRATAGENE (La Jolla, Calif.), NOVAGEN (Madison, Wis.), QIAGEN, Inc., (Valencia, Calif.), or InVitrogen (San Diego, Calif.).

Variant polypeptides can, alternatively, have 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99 percent identity with the polypeptide sequences of the instant invention. In a preferred embodiment, a variant or modified polypeptide exhibits approximately 85%, 86%, 87%, 88%, 89%, 90%, 91%, 92%, 93%, 94%, 95%, 96%, 97%, 98%, or 99% identity to a natural polypeptic of the invention. Typically, the percent identity is calculated with reference to the full length, native, and/or naturally occurring polypeptide (e.g., those polypeptides set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, or 27).

The nomenclature used to describe peptide compounds follows the conventional practice wherein the amino group is presented to the left (the N-terminus) and the carboxyl group to the right (the C-terminus) of each amino acid residue. When amino acid residue positions are referred to in an epitope, they are numbered in an amino to carboxyl direction with position one being the position closest to the amino terminal end of the epitope, or the peptide or protein of which it may be a part. In the formulae representing selected specific embodiments of the present invention, the amino- and carboxyl-terminal groups, although not specifically shown, are in the form they would assume at physiologic pH values, unless otherwise specified. In the amino acid structure formulae, each residue is generally represented by standard three-letter or single-letter designations (e.g., as set forth infra). By way of example, amino acid substitutions can be carried out without resulting in a substantial modification of the biological activity of the corresponding modified polypeptides; for example, the replacement of leucine with valine or isoleucine, of aspartic acid with glutamic acid, of glutamine with asparagine, of arginine with lysine, and the like, the reverse substitutions can be performed without substantial modification of the biological activity of the polypeptides.

The L-form of an amino acid residue is represented by a capital single letter or a capital first letter of a three-letter symbol, and the D-form, for those amino acids having D-forms, is represented by a lower case single letter or a lower case three letter symbol. Glycine has no asymmetric carbon atom and is simply referred to as "Gly" or G. Symbols for the amino acids are as follows: (Single Letter Symbol; Three Letter Symbol Amino Acid) A; Ala; Alanine: C; Cys; Cysteine: D; Asp; Aspartic Acid: E; Glu; Glutamic Acid: F; Phe; Phenylalanine: G; Gly; Glycine: H; His; Histidine: I; Ile; Isoleucine: K; Lys; Lysine: L; Leu; Leucine: M; Met; Methionine: N; Asn; Asparagine: P; Pro; Proline: Q; Gln; Glutamine: R; Arg; Arginine: S; Ser; Serine: T; Thr; Threonine: V; Val; Valine: W; Trp; Tryptophan: Y; Tyr; Tyrosine.

Amino acid "chemical characteristics" are defined as: Aromatic (F, W, Y); Aliphatic-hydrophobic (L, I, V, M); Small polar (S, T, C); Large polar (Q, N); Acidic (D, E); Basic (R, H, K); Non-polar: Proline; Alanine; and Glycine.

In order to extend the life of the polypeptides according to the invention, it may be advantageous to use non-natural amino acids, for example in the D-form, or alternatively amino acid analogs, for example sulfur-containing forms of amino acids in the production of "variant polypeptides". Alternative means for increasing the life of polypeptides can also be used in the practice of the instant invention. For example, polypeptides of the invention, and fragments thereof, can be recombinantly modified to include elements that increase the plasma, or serum half-life of the polypeptides of the invention. These elements include, and are not limited to, antibody constant regions (see for example, U.S.

Pat. No. 5,565,335, hereby incorporated by reference in its entirety, including all references cited therein), or other elements such as those disclosed in U.S. Pat. Nos. 6,319,691, 6,277,375, or 5,643,570, each of which is incorporated by reference in its entirety, including all references cited within each respective patent. Alternatively, the polynucleotides and genes of the instant invention can be recombinantly fused to elements, well known to the skilled artisan, that are useful in the preparation of immunogenic constructs for the purposes of vaccine formulation.

The subject invention also provides biologically active fragments (epitopes) of a polypeptide according to the invention and includes those peptides capable of eliciting an immune response directed against *P. falciparum*, said immune response providing components (B-cells, antibodies, and/or or components of the cellular immune response (e.g., helper, cytotoxic, and/or suppressor T-cells)) reactive with the biologically active fragment of a polypeptide; the intact, full length, unmodified polypeptide disclosed herein; or both the biologically active fragment of a polypeptide and the intact, full length, unmodified polypeptides disclosed herein.

Fragments, as described herein, can be obtained by cleaving the polypeptides of the invention with a proteolytic enzyme (such as trypsin, chymotrypsin, or collagenase) or with a chemical reagent, such as cyanogen bromide (CNBr). Alternatively, polypeptide fragments can be generated in a highly acidic environment, for example at pH 2.5. Such polypeptide fragments may be equally well prepared by chemical synthesis or using hosts transformed with an expression vector according to the invention. The transformed host cells contain a nucleic acid, allowing the expression of these fragments, under the control of appropriate elements for regulation and/or expression of the polypeptide fragments.

In one embodiment, the subject invention provides methods for eliciting an immune response in an individual comprising the administration of compositions comprising polypeptides according to the subject invention to an individual in amounts sufficient to induce an immune response in the individual. In some embodiments, a "protective" or "therapeutic immune response" is induced in the individual. A "protective immune response" or "therapeutic immune response" refers to a CTL (or CD8$^+$ T cell) and/or an HTL (or CD4$^+$ T cell), and/or an antibody response to an antigen derived from an infectious agent or a tumor antigen, which in some way prevents or at least partially arrests disease symptoms, side effects or progression. The protective immune response may also include an antibody response that has been facilitated by the stimulation of helper T cells (or CD4$^+$ T cells). Additional methods of inducing an immune response in an individual are taught in U.S. Pat. No. 6,419,931, hereby incorporated by reference in its entirety. The term CTL can be used interchangeably with CD8$^+$ T-cell(s) and the term HTL can be used interchangeably with CD4$^+$ T-cell(s) throughout the subject application.

The term "individual" includes mammals which include, and are not limited to, apes, chimpanzees, orangutans, humans, monkeys or domesticated animals (pets) such as dogs, cats, guinea pigs, hamsters, Vietnamese pot-bellied pigs, rabbits, ferrets, cows, horses, goats and sheep. In a preferred embodiment, the methods of inducing an immune response contemplated herein are practiced on humans.

Another embodiment of the subject invention provides methods of inducing an immune response in an individual comprising the administration of a composition comprising polypeptides encoded by the polynucleotides of the subject invention in amounts sufficient to induce an immune response. In some embodiments of the invention, the immune response provides protective immunity. The composition administered to the individual may, optionally, contain an adjuvant and may be delivered in any manner known in the art for the delivery of immunogen to a subject. Compositions may also be formulated in any carriers, including for example, pharmaceutically acceptable carriers such as those described in E. W. Martin's *Remington's Pharmaceutical Science*, Mack Publishing Company, Easton, Pa. In a preferred embodiment, compositions may be formulated in incomplete Freund's adjuvant.

In various embodiments, the subject invention provides for diagnostic assays based upon Western blot formats or standard immunoassays known to the skilled artisan. For example, antibody-based assays such as enzyme linked immunosorbent assays (ELISAs), radioimmunoassays (RIAs), lateral flow assays, immunochromatographic strip assays, automated flow assays, and assays utilizing antibody-containing biosensors may be employed for the detection of the polypeptides, and fragments thereof, provided by the subject invention. The assays and methods for conducting the assays are well-known in the art and the methods may test biological samples qualitatively (presence or absence of polypeptide) or quantitatively (comparison of a sample against a standard curve prepared using a polypeptide of the subject invention) for the presence of one or more polypeptide of the subject invention. Thus, the subject invention provides a method of detecting a *P. falciparum* polypeptide, or fragment thereof, comprising contacting a sample with an antibody that specifically binds to a polypeptide, or fragment thereof, comprising SEQ ID NOs: 1-26, or 27 and detecting the presence of an antibody-antigen complex.

The antibody-based assays can be considered to be of four types: direct binding assays, sandwich assays, competition assays, and displacement assays. In a direct binding assay, either the antibody or antigen is labeled, and there is a means of measuring the number of complexes formed. In a sandwich assay, the formation of a complex of at least three components (e.g., antibody-antigen-antibody) is measured. In a competition assay, labeled antigen and unlabelled antigen compete for binding to the antibody, and either the bound or the free component is measured. In a displacement assay, the labeled antigen is pre-bound to the antibody, and a change in signal is measured as the unlabelled antigen displaces the bound, labeled antigen from the receptor.

Lateral flow assays can be conducted according to the teachings of U.S. Pat. No. 5,712,170 and the references cited therein. U.S. Pat. No. 5,712,170 and the references cited therein are hereby incorporated by reference in their entireties. Displacement assays and flow immunosensors useful for carrying out displacement assays are described in: (1) Kusterbeck et al., "Antibody-Based Biosensor for Continuous Monitoring", in Biosensor Technology, R. P. Buck et al., eds., Marcel Dekker, N.Y. pp. 345-350 (1990); Kusterbeck et al., "A Continuous Flow Immunoassay for Rapid and Sensitive Detection of Small Molecules", Journal of Immunological Methods, vol. 135, pp. 191-197 (1990); Ligler et al., "Drug Detection Using the Flow Immunosensor", in Biosensor Design and Application, J. Findley et al., eds., American Chemical Society Press, pp. 73-80 (1992); and Ogert et al., "Detection of Cocaine Using the Flow Immunosensor", Analytical Letters, vol. 25, pp. 1999-2019 (1992), all of which are incorporated herein by reference in their entireties. Displacement assays and flow immunosensors are also described in U.S. Pat. No. 5,183,740, which is also incorporated herein by reference in its entirety. The displacement immunoassay, unlike most of the competitive immunoassays used to detect small molecules, can generate a positive signal with increasing antigen concentration. One aspect of the invention allows for the exclusion of Western blots as a diagnostic assay, particularly where the Western blot is a screen of whole cell lysates of *P. falciparum*, or related organisms, against immune serum of infected individuals. In another aspect of the invention, peptide, or polypeptide, based diagnostic assays utilize *P. falciparum* peptides or polypeptides that have been produce either by chemical peptide synthesis or by recombinant methodologies that utilize non-plasmodium host cells for the production of peptides or polypeptides.

Another aspect of the invention provides for the use of peptides, polypeptides, and multi-epitope constructs in assays such as those taught in U.S. Pat. No. 5,635,363, which is hereby incorporated by reference in its entirety. Briefly, peptides, polypeptides, and multi-epitope constructs of the subject invention can be used to form stable multimeric complexes that comprise prepared major histocompatibility complex (MHC) protein subunits having a substantially homogeneous bound peptide population. The multimeric MHC-antigen complex forms a stable structure with T cells recognizing the complex through their antigen receptor, thereby allowing for the labeling, identification and separation of specific T cells. The multimeric binding complex has the formula $(\alpha\text{-}\beta\text{-}P)_n$, where $n \geq 2$, usually $n \geq 4$, and usually $n \leq 10$; $\alpha$ is an $\alpha$ chain of a class I or class II MHC protein. $\beta$ is a $\beta$ chain, (the $\beta$ chain of a class II MHC protein or $\beta_2$ microglobulin for a MHC class I protein; and P is a peptide antigen. The multimeric complex stably binds through non-covalent interactions to a T cell receptor having the appropriate antigenic specificity. The MHC proteins may be from any individual. Of particular interest are the human HLA proteins. Included in the HLA proteins are the class II subunits HLA-DPα, HLA-DPβ, HLA-DQα, HLA-DQβ, HLA-DRα and HLA-DRβ, and the class I proteins HLA-A, HLA-B, HLA-C, and $\beta_2$-microglobulin. In a preferred embodiment, the MHC protein subunits are a soluble form of the normally membrane-bound protein. The soluble form is derived from the native form by deletion of the transmembrane domain. Conveniently, the protein is truncated, removing both the cytoplasmic and transmembrane domains. The protein may be truncated by proteolytic cleavage, or by expressing a genetically engineered truncated form. For class I proteins, the soluble form will include the α1, α2 and α3 domain. Not more than about 10, usually not more than about 5, preferably none of the amino acids of the transmembrane domain will be included. The deletion may extend as much as about 10 amino acids into the α3 domain, preferably none of the amino acids of the α3 domain will be deleted. The deletion will be such that it does not interfere with the ability of the α3 domain to fold into a disulfide bonded structure. The class I β chain, $\beta_2$-microglobulin, lacks a transmembrane domain in its native form, and need not be truncated. Generally, no Class II subunits will be used in conjunction with Class I subunits. Soluble class II subunits will include the α1 and α2 domains for the α subunit, and the β1 and β2 domains for the β subunit. Not more than about 10, usually not more than about 5, preferably none of the amino acids of the transmembrane domain will be included. The deletion may extend as much as about 10 amino acids into the α2 or β2 domain, preferably none of the amino acids of the β2 or β2 domain will be deleted. The deletion will be such that it does not interfere with the ability of the α2 or β2 domain to fold into a disulfide bonded structure.

The monomeric complex (α-β-P) (monomer) is multimerized. The resulting multimer will be stable over long periods of time. Usually not more than about 10% of the multimer will be dissociated after storage at 4° C. for about one day, more usually after about one week. Preferably, the multimer will be formed by binding the monomers to a multivalent entity through specific attachment sites on the α or β subunit, as described below in detail. The multimer may also be formed by chemical cross-linking of the monomers. A number of reagents capable of cross-linking proteins are known in the art, illustrative entities include: azidobenzoyl hydrazide, N-[4-(p-azidosalicylamino)butyl]-3'-[2'-pyridyldithio]propionamide), bis-sulfosuccinimidyl suberate, dimethyladipimidate, disuccinimidyltartrate, N-.gamma.-maleimidobutyryloxysuccinimide ester, N-hydroxy sulfosuccinimidyl-4-azidobenzoate, N-succinimidyl [4-azidophenyl]-1,3'-dithiopropionate, N-succinimidyl [4-iodoacetyl] aminobenzoate, glutaraldehyde, formaldehyde and succinimidyl 4-[N-maleimidomethyl]cyclohexane-1-carboxylate.

The attachment site for binding to a multivalent entity may be naturally occurring, or may be introduced through genetic engineering. The site will be a specific binding pair member or one that is modified to provide a specific binding pair member, where the complementary pair has a multiplicity of specific binding sites. Binding to the complementary binding member can be a chemical reaction, epitope-receptor binding or hapten-receptor binding where a hapten is linked to the subunit chain. In a preferred embodiment, one of the subunits is fused to an amino acid sequence providing a recognition site for a modifying enzyme. The recognition sequence will usually be fused proximal to the carboxy terminus of one of the subunit to avoid potential hindrance at the antigenic peptide binding site. Conveniently, an expression cassette will include the sequence encoding the recognition site.

Modifying enzymes of interest include BirA, various glycosylases, farnesyl protein transferase, protein kinases and the like. The subunit may be reacted with the modifying enzyme at any convenient time, usually after formation of the monomer. The group introduced by the modifying enzyme, e.g. biotin, sugar, phosphate, farnesyl, etc. provides a complementary binding pair member, or a unique site for further modification, such as chemical cross-linking, biotinylation, etc. that will provide a complementary binding pair member. An alternative strategy is to introduce an unpaired cysteine residue to the subunit, thereby introducing a unique and chemically reactive site for binding. The attachment site may also be a naturally occurring or introduced epitope, where the multivalent binding partner will be an antibody, e.g. IgG, IgM, etc. Any modification will be at a site, e.g. C-terminal proximal, that will not interfere with binding.

Exemplary of multimer formation is the introduction of the recognition sequence for the enzyme BirA, which catalyzes biotinylation of the protein substrate. The monomer with a biotinylated subunit is then bound to a multivalent binding partner, e.g. streptavidin or avidin, to which biotin binds with extremely high affinity. Streptavidin has a valency of 4, providing a multimer of $(\alpha\text{-}\beta\text{-}P)_4$.

The multivalent binding partner may be free in solution, or may be attached to an insoluble support. Examples of suitable insoluble supports include beads, e.g. magnetic beads, membranes and microtiter plates. These are typically made of glass, plastic (e.g. polystyrene), polysaccharides, nylon or nitrocellulose. Attachment to an insoluble support is useful when the binding complex is to be used for separation of T cells.

Frequently, the multimeric complex will be labeled, so as to be directly detectable, or will be used in conjunction with secondary labeled immunoreagents which will specifically bind the complex. In general the label will have a light detectable characteristic. Preferred labels are fluorophors, such as fluorescein isothiocyanate (FITC), rhodamine, Texas Red, phycoerythrin and allophycocyanin. Other labels of interest may include dyes, enzymes, chemiluminescers, particles, radioisotopes, or other directly or indirectly detectable agent. Conveniently, the multivalent binding partner will have the labeling group. Alternatively, a second stage label may be used, e.g. labeled antibody directed to one of the peptide constituents, and the like.

The binding complex will be used to detect and/or separate antigen specific T cells. The T cells may be from any source, usually having the same species of origin as the MHC heterodimer. The T cells may be from an in vitro culture, or a physiologic sample. For the most part, the physiologic samples employed will be blood or lymph, but samples may also involve other sources oft cells, particularly where T cells may be invasive. Thus other sites of interest are tissues, or associated fluids, as in the brain, lymph node, neoplasms, spleen, liver, kidney, pancreas, tonsil, thymus, joints, synovia, and the like. The sample may be used as obtained or may be subject to modification, as in the case of dilution, concentration, or the like. Prior treatments may involve removal of cells by various techniques, including centrifugation, using Ficoll-Hypaque, panning, affinity separation, using antibodies specific for one or more markers present as surface membrane proteins on the surface of cells, or any other technique that provides enrichment of the set or subset of cells of interest.

The binding complex is added to a suspension comprising T cells of interest, and incubated at about 4° C. for a period of time sufficient to bind the available cell surface receptor. The incubation will usually be at least about 5 minutes and usually less than about 30 minutes. It is desirable to have a sufficient concentration of labeling reagent in the reaction mixture, so that labeling reaction is not limited by lack of labeling reagent. The appropriate concentration is determined by titration. The medium in which the cells are labeled will be any suitable medium as known in the art. If live cells are desired a medium will be chosen that maintains the viability of the cells. A preferred medium is phosphate buffered saline containing from 0.1 to 0.5% BSA. Various media are commercially available and may be used according to the nature of the cells, including Dulbecco's Modified Eagle Medium (dMEM), Hank's Basic Salt Solution (HBSS), Dulbecco's phosphate buffered saline (dPBS), RPMI, Iscove's medium, PBS with 5 mM EDTA, etc., frequently supplemented with fetal calf serum, BSA, HSA, etc.

Where a second stage labeling reagent is used, the cell suspension may be washed and resuspended in medium as described above prior to incubation with the second stage reagent. Alternatively, the second stage reagent may be added directly into the reaction mix.

A number of methods for detection and quantitation of labeled cells are known in the art. Flow cytometry is a convenient means of enumerating cells that are a small percent of the total population. Fluorescent microscopy may also be used. Various immunoassays, e.g. ELISA, RIA, etc. may used to quantitate the number of cells present after binding to an insoluble support.

Flow cyometry may also be used for the separation of a labeled subset of T cells from a complex mixture of cells. The cells may be collected in any appropriate medium which maintains the viability of the cells, usually having a cushion of serum at the bottom of the collection tube. Various media are commercially available as described above. The cells may then be used as appropriate.

Alternative means of separation utilize the binding complex bound directly or indirectly to an insoluble support, e.g. column, microtiter plate, magnetic beads, etc. The cell sample is added to the binding complex. The complex may be bound to the support by any convenient means. After incubation, the insoluble support is washed to remove non-bound components. From one to six washes may be employed, with sufficient volume to thoroughly wash non-specifically bound cells present in the sample. The desired cells are then eluted from the binding complex. In particular the use of magnetic particles to separate cell subsets from complex mixtures is described in Miltenyi et al. (1990) Cytometry 11:231-238.

Detecting and/or quantitating specific T cells in a sample or fraction thereof may be accomplished by a variety of specific assays. In general, the assay will measure the binding between a patient sample, usually blood derived, generally in the form of plasma or serum and the subject multimeric binding complexes. The patient sample may be used directly, orb diluted as appropriate, usually about 1:10 and usually not more than about 1:10,000. Assays may be performed in any physiological buffer, e.g. PBS, normal saline, HBSS, dPBS, etc.

A sandwich assay is performed by first attaching the multimeric binding complex to an insoluble surface or support. The multimeric binding complex may be bound to the surface by any convenient means, depending upon the nature of the surface, either directly or through specific antibodies. The particular manner of binding is not crucial so long as it is compatible with the reagents and overall methods of the invention. They may be bound to the plates covalently or non-covalently, preferably non-covalently.

The insoluble supports may be any compositions to which the multimeric binding complex can be bound, which is readily separated from soluble material, and which is otherwise compatible with the overall method of measuring T cells. The surface of such supports may be solid or porous and of any convenient shape. Examples of suitable insoluble supports to which the receptor is bound include beads, e.g. magnetic beads, membranes and microtiter plates. These are typically made of glass, plastic (e.g. polystyrene), polysaccharides, nylon or nitrocellulose. Microtiter plates are especially convenient because a large number of assays can be carried out simultaneously, using small amounts of reagents and samples.

Before adding patient samples or fractions thereof, the non-specific binding sites on the insoluble support i.e. those not occupied by the multimeric binding complex, are generally blocked. Preferred blocking agents include non-interfering proteins such as bovine serum albumin, casein, gelatin, and the like. Samples, fractions or aliquots thereof are then added to separately assayable supports (for example, separate wells of a microtiter plate) containing support-bound multimeric binding complex.

Generally from about 0.001 to 1 ml of sample, diluted or otherwise, is sufficient, usually about 0.01 ml sufficing. Preferably, each sample and standard will be added to multiple wells so that mean values can be obtained for each. The incubation time should be sufficient for T cells to bind the insoluble binding complex. Generally, from about 0.1 to 3 hr is sufficient, usually 1 hr sufficing.

After incubation, the insoluble support is generally washed of non-bound components. Generally, a dilute physiologic buffer at an appropriate pH, generally 7-8, is used as a wash medium. From one to six washes may be employed, with sufficient volume to thoroughly wash non-specifically bound T cells present in the sample.

After washing, a solution containing specific second receptor is applied. The receptor may be any compound that binds patient T cells with sufficient specificity such that they can be distinguished from other components present. In a preferred embodiment, second receptors are antibodies specific for common T cell antigens, either monoclonal or polyclonal sera, e.g. anti-thy-1, anti-CD45, etc.

T cell specific antibodies may be labeled to facilitate direct or indirect quantification of binding. Examples of labels that permit direct measurement include radiolabels, such as $^3$H or $^{125}$I, fluorescers, dyes, beads, chemiluminescers, colloidal particles, and the like. Examples of labels which permit indirect measurement of binding include enzymes where the substrate may provide for a colored or fluorescent product. Examples of suitable enzymes for use in conjugates include horseradish peroxidase, alkaline phosphatase, malate dehydrogenase and the like. Where not commercially available, such antibody-enzyme conjugates are readily produced by techniques known to those skilled in the art.

Alternatively, the second receptor may be unlabeled. In this case, a labeled second receptor-specific compound is employed which binds to the bound second receptor. Such a second receptor-specific compound can be labelled in any of the above manners. It is possible to select such compounds such that multiple compounds bind each molecule of bound second receptor. Examples of second receptor/second receptor-specific molecule pairs include antibody/anti-antibody and avidin (or streptavidin)/biotin. Since the resultant signal is thus amplified, this technique may be advantageous where only a small number oft cells are present. An example is the use of a labeled antibody specific to the second receptor. More specifically, where the second receptor is a rabbit anti-allotypic antibody, an antibody directed against the constant region of rabbit antibodies provides a suitable second receptor specific molecule. The anti-immunoglobulin will usually come from any source other than human, such as ovine, rodentia, particularly mouse, or bovine.

The volume, composition and concentration of T cell specific receptor solution provides for measurable binding to the T cells already bound to the insoluble substrate. Generally, the same volume as that of the sample is used: from about 0.001 to 1 ml is sufficient, usually about 0.1 ml sufficing. When antibody ligands are used, the concentration generally will be about 0.1 to 50 µg/ml, preferably about 1 µg/ml. The solution containing the second receptor is generally buffered in the range of about pH 6.5-9.5. The solution may also contain an innocuous protein as previously described. The incubation time should be sufficient for the labeled ligand to bind available molecules. Generally, from about 0.1 to 3 hr is sufficient, usually 1 hr sufficing.

After the second receptor or second receptor-conjugate has bound, the insoluble support is generally again washed free of non-specifically bound second receptor, essentially as described for prior washes. After non-specifically bound material has been cleared, the signal produced by the bound conjugate is detected by conventional means. Where an enzyme conjugate is used, an appropriate enzyme substrate is provided so a detectable product is formed. More specifically, where a peroxidase is the selected enzyme conjugate, a preferred substrate combination is $H_2O_2$ and O-phenylenediamine which yields a colored product under appropriate reaction conditions. Appropriate substrates for other enzyme conjugates such as those disclosed above are known to those skilled in the art. Suitable reaction conditions as well as means for detecting the various useful conjugates or their products are also known to those skilled in the art. For the product of the substrate O-phenylenediamine for example, light absorbance at 490-495 nm is conveniently measured with a spectrophotometer.

Generally the number of bound T cells detected will be compared to control samples from samples having a different MHC context, e.g. T cells from an animal that does not express the MHC molecule used to make the binding complex.

An alternative protocol is to provide anti-T cell reagent, e.g. anti-thy-1, anti-CD45, etc. bound to the insoluble surface. After adding the sample and washing away non-specifically bound T cells, one or a combination of the subject binding complexes are added, where the binding complexes are labeled so as not to interfere with the binding to T cells.

It is particularly convenient in a clinical setting to perform the assays in a self-contained apparatus. A number of such methods are known in the art. The apparatus will generally employ a continuous flow-path of a suitable filter or membrane, having at least three regions, a fluid transport region, a sample region, and a measuring region. The sample region is prevented from fluid transfer contact with the other portions of the flow path prior to receiving the sample. After the sample region receives the sample, it is brought into fluid transfer relationship with the other regions, and the fluid transfer region contacted with fluid to permit a reagent solution to pass through the sample region and into the measuring region. The measuring region may have bound to it the multimeric binding complex, with a conjugate of an enzyme with T cell specific antibody employed as a reagent, generally added to the sample before application. Alternatively, the binding complex may be conjugated to an enzyme, with T cell specific antibody bound to the measurement region.

Detection of T cells is of interest in connection with a variety of conditions associated with T cell activation. Such conditions include autoimmune diseases, e.g. multiple sclerosis, myasthenia gravis, rheumatoid arthritis, type 1 diabetes, graft vs. host disease, Grave's disease, etc.; various forms of cancer, e.g. carcinomas, melanomas, sarcomas, lymphomas and leukemias. Various infectious diseases such as those caused by viruses, e.g. HIV-1, hepatitis, herpesviruses, enteric viruses, respiratory viruses, rhabdovirus, rubeola, poxvirus, paramyxovirus, morbillivirus, etc. are of interest. Infectious agents of interest also include bacteria, such as *Pneumococcus, Staphylococcus, Bacillus. Streptococcus, Meningococcus, Gonococcus, Eschericia, Klebsiella, Proteus, Pseudomonas, Salmonella, Shigella, Hemophilus, Yersinia, Listeria, Corynebacterium, Vibrio, Clostridia, Chlamydia, Mycobacterium, Helicobacter* and *Treponema*; protozoan pathogens, and the like. T cell associated allergic responses may also be monitored, e.g. delayed type hypersensitivity or contact hypersensitivity involving T cells.

Of particular interest are conditions having an association with a specific peptide or MHC haplotype, where the subject binding complexes may be used to track the T cell response with respect to the haplotype and antigen. A large number of associations have been made in disease states that suggest that specific MHC haplotypes, or specific protein antigens are responsible for disease states.

Polypeptide fragments, including immunogenic fragments, for each of SEQ ID NOs: 1-27 can be any length from at least 5 consecutive amino acids to 1 amino acid less than a full length polypeptide of any given SEQ ID NO:. Thus, for SEQ ID NO: 1 (used here as a non-limiting example) the polypeptide fragment can contain any number of consecutive amino acids from 5 to 1903 (for example, 5, 6, 7, . . . , 1901, 1902, 1903). For the sake of brevity, the individual integers between 5 and 1903 have not been reproduced herein but are, in fact, specifically contemplated. In one embodiment, the immunogenic fragments of the invention induce immunity or protective immunity from disease.

The present invention also provides for the exclusion of any individual fragment (of any given SEQ ID NO:) specified by N-terminal to C-terminal positions, actual sequence, or of any fragment specified by size (in amino acid residues) as described above. In addition, any number of fragments specified by N-terminal and C-terminal positions, actual sequence, or by size (in amino acid residues) as described above may be excluded as individual species. Further, any number of fragments specified by N-terminal and C-terminal positions or by size (in amino acid residues) as described above may be combined to provide a polypeptide fragment. These types of fragments may, optionally, include polypeptide sequences such as linkers, described below.

Where a claim recites "a polypeptide comprising SEQ ID NO: X, or fragments or immunogenic fragments or epitopes of SEQ ID NO:X", the language "fragments or immunogenic fragments or epitopes of SEQ ID NO:X" specifically excludes identical sub-sequences found within other longer naturally occurring prior art polypeptide or protein sequences that are not identical to sequence from which the claimed sequence was derived. This does not include instances where such sub-sequences are a part of a larger molecule specifically modified by the hand of man to enhance the immunogenicity of the fragments of the subject invention. Thus, fragments or immunogenic fragments or epitopes of SEQ ID NO:X specifically exclude, and are not to be considered anticipated, where the fragment is a sub-sequence of another naturally occurring non-malarial peptide, polypeptide, or protein isolated from a bacterial, viral, reptilian, insect, avian, or mammalian source and is identified in a search of protein sequence databases.

Fragments or immunogenic fragments or epitopes of the invention may further contain linkers that facilitate the attachment of the fragments to a carrier molecule for the stimulation of an immune response or diagnostic purposes. The linkers can also be used to attach fragments according to the invention to solid support matrices for use in affinity purification protocols. In this aspect of the invention, the linkers specifically exclude, and are not to be considered anticipated, where the fragment is a subsequence of another peptide, polypeptide, or protein as identified in a search of protein sequence databases as indicated in the preceding paragraph. In other words, the non-identical portions of the other peptide, polypeptide, of protein are not considered to be a "linker" in this aspect of the invention. Non-limiting examples of "linkers" suitable for the practice of the invention include chemical linkers (such as those sold by Pierce, Rockford, Ill.) and peptides that allow for the connection of the immunogenic fragment to a carrier molecule (see, for example, linkers disclosed in U.S. Pat. Nos. 6,121,424, 5,843,464, 5,750,352, and 5,990,275, hereby incorporated by reference in their entirety). In various embodiments, the linkers can be up to 50 amino acids in length, up to 40 amino acids in length, up to 30 amino acids in length, up to 20 amino acids in length, up to 10 amino acids in length, or up to 5 amino acids in length. Of course, the linker may be any pre-selected number of amino acids (up to 50 amino acids) in length.

In various embodiments, polypeptides suitable for use in various disclosed methods of the subject invention can be selected from the group consisting of: a) a polypeptide comprising a polypeptide sequence selected from the group consisting of SEQ ID NOs: 1, 2, 3, 4, 5, 6, 7, 8, 9, 10, 11, 12, 13, 14, 15, 16, 17, 18, 19, 20, 21, 22, 23, 24, 25, 26, and 27; b) a variant polypeptide having at least about 20% to 99.99% identity to a polypeptide selected from the group consisting of SEQ ID NO: 1, 2, 3, 4, 5, 6, 7, 8, 9, 10, 11, 12, 13, 14, 15, 16, 17, 18, 19, 20, 21, 22, 23, 24, 25, 26, and 27; c) a fragment of a polypeptide or a variant polypeptide of SEQ ID NO: 1, 2, 3, 4, 5, 6, 7, 8, 9, 10, 11, 12, 13, 14, 15, 16, 17, 18, 19, 20, 21, 22, 23, 24, 25, 26, or 27, wherein said fragment or variant has substantially the same serologic reactivity or substantially the same T-cell reactivity as the native polypeptide; d) a multi-epitope construct; and e) combinations thereof.

Multi-Epitope Constructs

As indicated supra, the subject invention provides for "multi-epitope constructs". A "multi-epitope construct" comprises: 1) nucleic acids that encode multiple polypeptide epitopes (of any length) that can bind to one or more molecules functioning in the immune system; or 2) polypeptides comprising multiple polypeptide epitopes that can bind to one or more molecules functioning in the immune system. "Multi-epitope constructs" can, optionally, contain "flanking" or "spacing" residues between each epitope. Some embodiments provide for "multi-epitope constructs" that comprise a series of the same epitope (termed "homopolymers"). Other embodiments provide for "multi-epitope constructs" that comprise a combination or series of different epitopes, optionally connected by "flanking" or "spacing" residues (termed "heteropolymers"). In some embodiments, "multi-epitope constructs" may exclude full-length polypeptides from which the epitopes are obtained (e.g., the polypeptides of SEQ ID NOs: 1-27). In certain preferred embodiments, the epitopes used in the formation of the multi-epitope construct are selected from those set forth in Table 2, Table 3, Table 4, Table 5, and/or Table 6 and any epitope set forth in these Tables 2-6 can be mixed and/or matched any other epitope set forth in any of the aforementioned Tables 2-6.

Multi-epitope constructs may be of "high affinity" or "intermediate affinity". As used herein, "high affinity" with respect to HLA class I molecules is defined as binding with an $IC_{50}$, or KD value, of 50 nM or less; "intermediate affinity" with respect to HLA class I molecules is defined as binding with an $IC_{50}$ or KD value of between about 50 and about 500 nM. "High affinity" with respect to binding to HLA class II molecules is defined as binding with an $IC_{50}$ or KD value of 100 nM or less; "intermediate affinity" with respect to binding to HLA class II molecules is defined as binding with an $IC_{50}$ or KD value of between about 100 and about 1000 nM.

The multi-epitope constructs described herein preferably include five or more, ten or more, fifteen or more, twenty or more, or twenty-five or more epitopes. Other embodiments provide multi-epitope constructs that comprise at least 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99 epitopes. All of the epitopes in a multi-epitope construct may be from one organism (e.g., the epitopes are obtained from P. falciparum), or the multi-epitope construct may include epitopes present in two or more different organisms (e.g., some epitopes from P. falciparum and some epitopes from another organism). Additionally, the same epitope may be present in a multi-epitope construct at more than one location in the construct. In some embodiments, novel epitopes of the subject invention may be linked to known epitopes of an organism (e.g., P. falciparum or another organism).

A "multi-epitope vaccine," is a vaccine comprising multiple epitopes. A multi-epitope vaccine can induce an immune response and is administered to an individual in an amount sufficient to induce an immune response in the individual. In some embodiments, the immune response induced by the multi-epitope vaccine is a protective immune response against a given organism, pathogen, or pathologic condition (e.g., *P. falciparum*).

In certain embodiments, the epitopes of a multi-epitope construct or the polypeptides disclosed herein interact with an antigen binding site of an antibody molecule, a class I HLA, a T-cell receptor, and/or a class II HLA molecule. In certain preferred embodiments, the epitopes interact with an HLA molecule (e.g., class I or class II) or a T-cell receptor. In an even more preferred embodiment, the epitope interacts with both an HLA molecule (e.g., class I or class II) and a T-cell receptor. In various embodiments, all of the nucleic acids in a multi-epitope construct can encode class I HLA epitopes or class II HLA epitopes. Multi-epitope constructs comprising epitopes that interact exclusively with class I HLA molecules may be referred to as "CTL multi-epitope constructs" (or "CD8+ T cell multi-epitope constructs"). Multi-epitope constructs comprising epitopes that interact exclusively with class II HLA molecules may be referred to as "HTL multi-epitope constructs" (or "CD4+ T cell multi epitope constructs"). Some multi-epitope constructs (designated "TL multi-epitope constructs") can have a subset of the multi-epitope nucleic acids encoding class I HLA epitopes and another subset of the multi-epitope nucleic acids encoding class II HLA epitopes (e.g., the constructs stimulate both CTL (i.e., CD8+ T cell) and HTL (i.e., CD4+ T cell) of the immune system). Other multi-epitope constructs can provide epitopes that interact exclusively with B-cells or immunoglobulin molecules and are designated "BL multi-epitope constructs". Multi-epitope constructs that provide epitopes that interact with B-cells (and/or immunoglobulin molecules) and further provide class I HLA epitopes and class II HLA epitopes are designated "immune system (IMS) multi-epitope constructs". In certain embodiments, multi-epitope constructs can provide class I or class II epitopes (e.g., CTL (i.e., CD8+ T cell) epitopes or HTL (i.e., CD4+ T cell) epitopes) and BL epitopes. "Human Leukocyte Antigen" or "HLA" is a human class I or class II Major Histocompatibility Complex (MHC) protein (see, e.g., Stites, et al., IMMUNOLOGY, 8$^{TH}$ ED., Lange Publishing, Los Altos, Calif. (1994)).

CTL epitope (class I epitope) (i.e., CD8+ T cell epitope) encoding nucleic acids preferably provide an epitope peptide of about eight to about thirteen amino acids in length (e.g., 8, 9, 10, 11, 12 or 13), more preferably about eight to about eleven amino acids in length, and most preferably about nine amino acids in length. HTL (CD4+ T-cell) epitope nucleic acids can provide an epitope peptide of about seven to about twenty three (e.g., 7, 8, 9, 10, 11, 12, 13, 14, 15, 16, 17, 18, 19, 20, 21, 22 or 23) preferably about seven to about seventeen (e.g., 7, 8, 9, 10, 11, 12, 13, 14, 15, 16, or 17, more preferably about eleven to about fifteen (e.g., 11, 12, 13, 14 or 15), and most preferably about thirteen amino acids in length.

"Degenerate binding" indicates that a peptide is bound by more than one HLA molecule; a synonym is "cross reactive binding." "Cross reactive binding" may also be used to define the interaction of an antigen with multiple populations of antibodies. In certain preferred embodiments, epitopes disclosed herein do not exhibit cross reactive or degenerate binding. Other embodiments encompass degenerate or cross reactive binding of antigens or epitopes.

With regard to a particular amino acid sequence, an "epitope" is a set of amino acid residues that is involved in recognition by a particular immunoglobulin, or in the context of T cells, those residues necessary for recognition by T cell receptor proteins and/or Major Histocompatibility Complex (MHC) receptors. In an immune system setting, in vitro or in vivo, an epitope is the collective features of a molecule, such as primary, secondary and tertiary peptide structure, and charge, that together form a site recognized by an immunoglobulin, T cell receptor or HLA molecule. Throughout this disclosure epitope and peptide are often used interchangeably. It is to be appreciated, however, that isolated or purified protein or peptide molecules larger than and comprising an epitope of the invention are still within the bounds of the invention.

A "flanking" or "linking" residue is a residue that is positioned next to an epitope. A flanking residue can be introduced or inserted at a position adjacent to the N-terminus or the C-terminus of an epitope. Flanking residues suitable for use in the subject invention are disclosed, for example, in U.S. Pat. No. 6,419,931, which is hereby incorporated by reference in its entirety, including all sequences, figures, references, and tables.

An "immunogenic peptide" or "peptide epitope" is a peptide that comprises an allele-specific motif or supermotif such that the peptide will bind an HLA molecule and induce a CTL (or CD8+ T cell) and/or HTL (or CD4+ T cell) response. An "immunogenic peptide" or "peptide epitope" can also be a peptide that comprises a motif that binds to antibody molecules or B-cells found in the immune system of an individual. Thus, immunogenic peptides of the invention are capable of binding to an antibody molecule, a B-cell, or appropriate HLA molecule and thereafter inducing an immune response (e.g., the induction of antibody production, a cytotoxic T cell response, or a helper T cell response) to the antigen from which the immunogenic peptide is derived.

The term "residue" refers to an amino acid or amino acid mimetic incorporated into a peptide or protein by an amide bond or amide bond mimetic.

A "spacer" or "linker" refers to a sequence that is inserted between two epitopes in a multi-epitope construct to prevent the occurrence of junctional epitopes and/or to increase the efficiency of processing. A multi-epitope construct may have one or more spacer nucleic acids. A spacer nucleic acid may flank each epitope nucleic acid in a construct, or the spacer nucleic acid to epitope nucleic acid ratio may be about 2 to 10, about 5 to 10, about 6 to 10, about 7 to 10, about 8 to 10, or about 9 to 10, where a ratio of about 8 to 10 has been determined to yield favorable results for some constructs. The spacer nucleic acid may encode one or more amino acids. A spacer nucleic acid flanking a class I HLA epitope in a multi-epitope construct is preferably between one and about eight amino acids in length. A spacer nucleic acid flanking a class II HLA epitope in a multi-epitope construct is preferably greater than five, six, seven, or more amino acids in length, and more preferably five or six amino acids in length. The number of spacers in a construct, the number of amino acids in a spacer, and the amino acid composition of a spacer can be selected to optimize epitope processing and/or minimize junctional epitopes. It is preferred that spacers are selected by concomitantly optimizing epitope processing and junctional motifs. Suitable amino acids for optimizing epitope processing are described herein. Also, suitable amino acid spacing for minimizing the number of junctional epitopes in a construct are described herein for class I and class II HLAs. For example, spacers flanking class II HLA epitopes preferably include G, P, and/or N residues as these are not generally known to be primary anchor residues (see, e.g., PCT/US00/19774). A particularly preferred spacer for flanking a class II HLA epitope includes alternating G and P residues, for example, $(GP)_n$, $(PG)_n$, $(GP)_nG$, or $(PG)_nP$, and so forth, where n is an integer between one and ten, preferably two or about two, and where a specific example of such a spacer is GPGPG.

In some multi-epitope constructs, it is sufficient that each spacer nucleic acid encodes the same amino acid sequence. In multi-epitope constructs having two spacer nucleic acids encoding the same amino acid sequence, the spacer nucleic acids encoding those spacers may have the same or different nucleotide sequences, where different nucleotide sequences may be preferred to decrease the likelihood of unintended recombination events when the multi-epitope construct is inserted into cells.

In other multi-epitope constructs, one or more of the spacer nucleic acids may encode different amino acid sequences. While many of the spacer nucleic acids may encode the same amino acid sequence in a multi-epitope construct, one, two, three, four, five or more spacer nucleic acids may encode different amino acid sequences, and it is possible that all of the spacer nucleic acids in a multi-epitope construct encode different amino acid sequences. Spacer nucleic acids may be optimized with respect to the epitope nucleic acids they flank by determining whether a spacer sequence will maximize epitope processing and/or minimize junctional epitopes, as described herein.

Multi-epitope constructs may be distinguished from one another according to whether the spacers in one construct optimize epitope processing or minimize junctional epitopes over another construct, and preferably, constructs may be distinguished where one construct is concomitantly optimized for epitope processing and junctional epitopes over the other. Computer assisted methods and in vitro and in vivo laboratory methods for determining whether a construct is optimized for epitope processing and junctional motifs are described herein.

"Multi-epitope constructs of the invention may also be "optimized". The term "optimized" or "optimizing" refers to increasing the immunogenicity or antigenicity of a multi-epitope construct having at least one epitope pair by sorting epitopes to minimize the occurrence of junctional epitopes, inserting flanking residues that flank the C-terminus or N-terminus of an epitope, and inserting spacer residue to further prevent the occurrence of junctional epitopes or to provide a flanking residue. An increase in immunogenicity or antigenicity of an optimized multi-epitope construct is measured relative to a multi-epitope construct that has not been constructed based on the optimization parameters and is using assays known to those of skill in the art, e.g., assessment of immunogenicity in HLA transgenic mice, ELISPOT, interferon-gamma release assays, tetramer staining, chromium release assays, and presentation on dendritic cells.

The subject invention also concerns antibodies that bind to polypeptides of the invention. Antibodies that are immunospecific for the malarial polypeptides set forth herein are specifically contemplated. In various embodiments, antibodies which do not cross react with other proteins or malarial proteins are also specifically contemplated. The antibodies of the subject invention can be prepared using standard materials and methods known in the art (see, for example, *Monoclonal Antibodies: Principles and Practice,* 1983; *Monoclonal Hybridoma Antibodies: Techniques and Applications,* 1982; *Selected Methods in Cellular Immunology,* 1980; *Immunological Methods, Vol. II,* 1981; *Practical Immunology,* and Kohler et al. [1975] *Nature* 256:495).

The term "antibody" is used in the broadest sense and specifically covers monoclonal antibodies (including full length monoclonal antibodies), polyclonal antibodies, multi-specific antibodies (e.g., bispecific antibodies), and antibody fragments so long as they exhibit the desired biological activity, particularly neutralizing activity. "Antibody fragments" comprise a portion of a full length antibody, generally the antigen binding or variable region thereof. Examples of antibody fragments include Fab, Fab', F(ab')$_2$, and Fv fragments; diabodies; linear antibodies; single-chain antibody molecules; and multi-specific antibodies formed from antibody fragments.

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic site. Furthermore, in contrast to conventional (polyclonal) antibody preparations that typically include different antibodies directed against different determinants (epitopes), each monoclonal antibody is directed against a single determinant on the antigen. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler et al. [1975] *Nature* 256: 495, or may be made by recombinant DNA methods (see, e.g., U.S. Pat. No. 4,816,567). The "monoclonal antibodies" may also be isolated from phage antibody libraries using the techniques described in Clackson et al. [1991] *Nature* 352: 624-628 and Marks et al. [1991] *J. Mol. Biol.* 222: 581-597, for example.

The monoclonal antibodies described herein specifically include "chimeric" antibodies (immunoglobulins) in which a portion of the heavy and/or light chain is identical with or homologous to corresponding sequences in antibodies derived from a particular species or belonging to a particular antibody class or subclass, while the remainder of the chain(s) is identical with or homologous to corresponding sequences in antibodies derived from another species or belonging to another antibody class or subclass, as well as fragments of such antibodies, so long as they exhibit the desired biological activity (U.S. Pat. No. 4,816,567; and Morrison et al. [1984] *Proc. Natl. Acad Sci. USA* 81: 6851-6855). Also included are humanized antibodies, such as those taught in U.S. Pat. No. 6,407,213 or 6,417,337 which are hereby incorporated by reference in their entirety.

"Single-chain Fv" or "sFv" antibody fragments comprise the $V_H$ and $V_L$ domains of an antibody, wherein these domains are present in a single polypeptide chain. Generally, the Fv polypeptide further comprises a polypeptide linker between the $V_H$ and $V_L$ domains which enables the sFv to form the desired structure for antigen binding. For a review of sFv see Pluckthun in The Pharmacology of Monoclonal Antibodies [1994] Vol. 113:269-315, Rosenburg and Moore eds. Springer-Verlag, New York.

The term "diabodies" refers to small antibody fragments with two antigen-binding sites, which fragments comprise a heavy chain variable domain ($V_H$) connected to a light chain variable domain ($V_L$) in the same polypeptide chain ($V_H$-$V_L$). Diabodies are described more fully in, for example, EP 404, 097; WO 93/11161; and Hollinger et al. [1993] *Proc. Natl. Acad. Sci. USA* 90: 6444-6448. The term "linear antibodies" refers to the antibodies described in Zapata et al. [1995] *Protein Eng.* 8(10):1057-1062.

An "isolated" antibody is one which has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

The terms "comprising", "consisting of" and "consisting essentially of" are defined according to their standard meaning. The terms may be substituted for one another throughout the instant application in order to attach the specific meaning associated with each term. The phrases "isolated" or "biologically pure" refer to material that is substantially or essentially free from components which normally accompany the material as it is found in its native state. Thus, isolated peptides in accordance with the invention preferably do not contain materials normally associated with the peptides in their in situ environment. "Link" or "join" refers to any method known in the art for functionally connecting peptides, including, without limitation, recombinant fusion, covalent bonding, disulfide bonding, ionic bonding, hydrogen bonding, and electrostatic bonding.

Following are examples which illustrate procedures for practicing the invention. These examples should not be construed as limiting. All percentages are by weight and all solvent mixture proportions are by volume unless otherwise noted.

In this disclosure, "binding data" results are often expressed in terms of "$IC_{50}$'s." $IC_{50}$ is the concentration of peptide in a binding assay at which 50% inhibition of binding of a reference peptide is observed. Given the conditions in which the assays are run (i.e., limiting HLA proteins and labeled peptide concentrations), these values approximate KD values. Assays for determining binding are described in detail, e.g., in PCT publications WO 94/20127 and WO 94/03205 (each of which is hereby incorporated by reference in its entirety). It should be noted that $IC_{50}$ values can change, often dramatically, if the assay conditions are varied, and depending on the particular reagents used (e.g., HLA preparation, etc.). For example, excessive concentrations of HLA molecules will increase the apparent measured $IC_{50}$ of a given ligand. Alternatively, binding is expressed relative to a reference peptide. Although as a particular assay becomes more, or less, sensitive, the $IC_{50}$'s of the peptides tested may change somewhat, the binding relative to the reference peptide will not significantly change. For example, in an assay run under conditions such that the $IC_{50}$ of the reference peptide increases 10-fold, the $IC_{50}$ values of the test peptides will also shift approximately 10-fold. Therefore, to avoid ambiguities, the assessment of whether a peptide is a good, intermediate, weak, or negative binder is generally based on its $IC_{50}$, relative to the $IC_{50}$ of a standard peptide. Binding may also be determined using other assay systems including those using: live cells (e.g., Ceppellini et al., Nature 339:392, 1989; Christnick et al., Nature 352:67, 1991; Busch et al., Int. Immunol. 2:443, 19990; Hill et al., J. Immunol. 147:189, 1991; del Guercio et al., J. Immunol. 154:685, 1995), cell free systems using detergent lysates (e.g., Cerundolo et al., J. Immunol. 21:2069, 1991), immobilized purified MHC (e.g., Hill et al., J. Immunol. 152, 2890, 1994; Marshall et al., J. Immunol. 152:4946, 1994), ELISA systems (e.g., Reay et al., EMBO J. 11:2829, 1992), surface plasmon resonance (e.g., Khilko et al., J. Biol. Chem. 268:15425, 1993); high flux soluble phase assays (Hammer et al., J. Exp. Med. 180:2353, 1994), and measurement of class I MHC stabilization or assembly (e.g., Ljunggren et al., Nature 346:476, 1990; Schumacher et al., Cell 62:563, 1990; Townsend et al., Cell 62:285, 1990; Parker et al., J. Immunol. 149:1896, 1992). Predicted $IC_{50}$ values may be referred to as PIC values and measured $IC_{50}$ values may be referred to a MIC values.

Example 1

Starting with 27 open reading frames defined by Multidimensional Protein Identification Technology, 9 highly antigenic proteins were identified. These highly antigenic proteins were recognized by volunteers immunized with irradiated sporozoites; mock immunized individuals (controls) failed to recognize these proteins. Several of these nine proteins were more antigenic than previously well-characterized proteins.

To identify and prioritize a set of ORFs representing antigens potentially expressed in the sporozoite and intrahepatic stage of the parasite life cycle, MS/MS spectra of peptide sequences generated by Multidimensional Protein Identification Technology (MudPIT) (Washburn, M. P., Wolters, D., & Yates, J. R. 3$^{rd}$. Large-scale analysis of the yeast proteome by multidimensional protein identification technology. *Nat. Biotechnol.* 19, 242-247 (2001)) of *P. falciparum* sporozoite preparations were scanned against the *P. falciparum* genomic sequence database using SEQUEST™ software (Florens, L. et al. A proteomic view of the *Plasmodium falciparum* life cycle. Submitted). A panel of 27 ORF's (10 expressed only in sporozoites, and 17 common to other stages of the parasite life cycle) were selected. Their size ranged between 96-4544 amino acids (mean 1252), the percentage of the protein covered by identified peptides ranged between 0.5-49.5%, and the frequency of recognition in the *P. falciparum* proteome dataset ranged between 16 peptide hits from 6 different sporozoite runs (antigen 2) to single peptide hits (antigens 1, 11, 14, 16, 19 and 25. When searched against the final *P. falciparum* database using refined gene model predictions, and taking into consideration genomic sequence information from the *Anopheles* (vector) and human (host) databases, 19 of the 27 antigens could be identified using stringent selection criteria and six others could be identified only with relaxed criteria.

Amino acid sequences from the 27 ORFs were scanned with HLA-A1, A2, A3/A11, A24 and DR supertype PIC algorithms; a total of 3241 peptides were identified (range=14-435; mean=120 sequences per antigen). A set of 1142 sequences was synthesized (range=13-50; mean=42), selecting the top 10 scorers per supertype per antigen for larger ORFs. Control sets of peptides were synthesized from 4 known antigens (PfCSP, PfSSP2, PfLSA1 and PfEXP1). Next, predicted epitopes were tested for their capacity to induce recall IFN-γ immune responses using PBMC from volunteers immunized with irradiated *P. falciparum* sporozoites and either protected (n=4) or not protected (n=4) against challenge with infectious sporozoites, or control volunteers mock immunized in parallel (n=4) (see Table 1). Peptides were tested as pools, at 1 μg/ml each peptide with each antigen represented by a separate pool, by IFN-γ ELIspot (Washburn, M. P., Wolters, D., & Yates, J. R. 3$^{rd}$. Large-scale analysis of the yeast proteome by multidimen sional protein identification technology. *Nat. Biotechnol.* 19, 242-247 (2001)). Positive and negative control epitopes from well characterized antigens (CMV, Influenza, EBV, HIV) were also included.

Considering a stimulation index (ratio test response/control) >2.0 as positive, 19 of the 27 unknown antigens were recognized by at least 1 of 8 irradiated sporozoite immunized volunteers, but not by any of the 4 mock immunized controls (Table 1). Nine of the 27 antigens (#2, 5, 3, 18, 22, 21, 13, 11, 20) were recognized by at least 50% of irradiated sporozoite volunteers in at least 25% of assays, 3 antigens (#1, 12, 17) were recognized by at least 25% of volunteers in at least 15% of assays, and 7 antigens (#6, 7, 9, 14, 15, 16, 19) were recognized by at least 10% volunteers in at least 5% of assays. Eight of the 27 unknown antigens (#4, 8, 10, 23, 24, 25, 26, 27) failed to induce IFN-γ responses of sufficient magnitude to meet our criteria of positivity. Pools of predicted epitopes from the known antigens, PfCSP, PfSSP2, PfLSA1 and PfEXP1, were also recognized by irradiated sporozoite volunteers although the frequency of response to those pools was somewhat lower than that to pools of peptides representing previously validated epitopes derived from the same antigens (Doolan, D. L. et al. Degenerate cytotoxic T cell epitopes from *P. falciparum* restricted by multiple HLA-A and HLA-B supertype alleles. *Immunity.* 7, 97-112 (1997); Doolan, D. L. et al. HLA-DR-promiscuous T cell epitopes from *Plasmodium flaciparum* pre-erthrocytic-stage antigens restricted by multiple HLA class II alleles. *J Immunol.* 165:1123-1137 (2000); Wang, R., et al. Induction of CD4(+) T cell-dependent CD8(+) type 1 responses in humans by a malaria DNA vaccine. *Proc. Natl. Acad. Sci. U.S.A.* 98, 10817-10822 (2001)) (Table 1). Particularly noteworthy, the reactivity against several of the newly identified antigens greatly exceeded the reactivities observed against all 4 known antigens For example, both antigens 2 and 5 were recognized by 7/8 irradiated sporozoite volunteers in 9/16 assays, and antigens 3 and 18 were recognized by 6/8 irradiated sporozoite volunteers in 6/16 assays.

Results show that HLA-A2 peptide pools from antigens 2, 5 and 13, and HLA-A1 and HLA-DR peptide pools from antigens 2 and 5, are recognized by irradiated sporozoite volunteers who express the respective HLA alleles, but not by mock immunized controls. Deconvolution at the level of individual epitopes is in progress. Additionally, a comprehensive analysis of HLA binding against the A1, A2, A3/11, A24, and DR1 supertypes has been completed for selected antigens. Several degenerate binders have been identified for each supertype/antigen combination, and 50 to 70% of the predicted peptides have been identified as degenerate HLA binders. Further analysis also revealed that the antigenicity results correlate to a large degree with the proteomic data. For example, of 9 antigens associated with high immune reactivity, 7 were identified by multiple peptide hits in multiple MudPIT runs All patents, patent applications, provisional applications, polynucleotide sequences, amino acid sequences, tables and publications referred to or cited herein are incorporated by reference in their entirety, including all figures, to the extent they are not inconsistent with the explicit teachings of this specification. It should be understood that the examples and embodiments described herein are for illustrative purposes only and that various modifications or changes in light thereof will be suggested to persons skilled in the art and are to be included within the spirit and purview of this application.

TABLE 1

Summary of immune reactivities against the panel of 27 putative antigens and 4 known antigens.

| Antigen | IRRADIATED SPOROZOITE IMMUNIZED | | | | | | MOCK IMMUNIZED | |
| --- | --- | --- | --- | --- | --- | --- | --- | --- |
| | # vol respond | % vol respond | # assays | % assays | SI respond | SFC respond | # vol respond | # assays |
| 1 | 3 | 37.5 | 3 | 18.75 | 2.5 | 59.3 | 0 | 0 |
| 2 | 8 | 100 | 9 | 56.25 | 2.9 | 110.4 | 0 | 0 |
| 3 | 6 | 75 | 6 | 37.5 | 2.6 | 119.1 | 0 | 0 |
| 4 | 0 | — | — | — | — | — | 0 | 0 |
| 5 | 7 | 87.5 | 9 | 56.25 | 2.8 | 101.8 | 0 | 0 |
| 6 | 1 | 12.5 | 1 | 6.25 | 2.4 | 88.3 | 0 | 0 |
| 7 | 1 | 12.5 | 1 | 6.25 | 2.1 | 43.3 | 0 | 0 |
| 8 | 0 | — | — | — | — | — | 0 | 0 |
| 9 | 2 | 25 | 2 | 12.5 | 2.5 | 32.0 | 0 | 0 |
| 10 | 0 | — | — | — | — | — | 0 | 0 |
| 11 | 4 | 50 | 4 | 25 | 3.1 | 81.3 | 0 | 0 |
| 12 | 3 | 37.5 | 3 | 18.75 | 2.2 | 48.2 | 0 | 0 |
| 13 | 4 | 50 | 5 | 31.25 | 2.9 | 92.2 | 0 | 0 |
| 14 | 1 | 12.5 | 1 | 6.25 | 2.2 | 55.3 | 0 | 0 |
| 15 | 2 | 25 | 2 | 12.5 | 2.5 | 28.8 | 0 | 0 |
| 16 | 2 | 25 | 2 | 12.5 | 2.2 | 27.2 | 0 | 0 |
| 17 | 3 | 37.5 | 3 | 18.75 | 2.4 | 57.6 | 0 | 0 |
| 18 | 6 | 75 | 6 | 37.5 | 2.2 | 58.4 | 0 | 0 |
| 19 | 2 | 25 | 2 | 12.5 | 2.7 | 31.3 | 0 | 0 |
| 20 | 4 | 50 | 4 | 25 | 2.5 | 74.8 | 0 | 0 |
| 21 | 4 | 50 | 5 | 31.25 | 2.3 | 48.2 | 0 | 0 |
| 22 | 5 | 62.5 | 5 | 31.25 | 2.9 | 108.4 | 0 | 0 |
| 23 | 0 | — | — | — | — | — | 0 | 0 |
| 24 | 0 | — | — | — | — | — | 0 | 0 |
| 25 | 0 | — | — | — | — | — | 0 | 0 |
| 26 | 0 | — | — | — | — | — | 0 | 0 |
| 27 | 0 | — | — | — | — | — | 0 | 0 |
| TOTAL UNKNOWNS | 1-8 | 44.7 | 3.8 | 24.0 | 2.5 | 66.6 | | |
| "HIGH" | 4-8 | 66.7 | 5.9 | 36.8 | 2.7 | 88.3 | | |
| "INTERMEDIATE" | 3 | 37.5 | 3.0 | 18.8 | 2.4 | 55.0 | | |

TABLE 1-continued

Summary of immune reactivities against the panel of 27 putative antigens and 4 known antigens.

| Antigen | IRRADIATED SPOROZOITE IMMUNIZED | | | | | | MOCK IMMUNIZED | |
|---|---|---|---|---|---|---|---|---|
| | # vol respond | % vol respond | # assays | % assays | SI respond | SFC respond | # vol respond | # assays |
| "LOW" | 1-2 | 19.6 | 1.6 | 9.8 | 2.4 | 43.8 | | |
| Range | 1-8 | 12.5-100 | 1-9 | 6.25-56.25 | 2.1-3.1 | 27.2-110.4 | | |
| KNOWNS (@1 ug/ml) predicted | 1.4 | 17.2 | 1.4 | 8.6 | 2.9 | 57.3 | | |
| Range | 1-3 | 12.5-37.5 | 1-3 | 6.25-18.75 | 2.0-3.4 | 30.5-137.4 | | |
| KNOWNS (@1 ug/ml) validated | 4.0 | 50.0 | 3.8 | 23.4 | 3.5 | 64.0 | | |
| Range | 3-5 | 37.5-62.5 | 3-6 | 18.75-37.5 | 3.5-3.6 | 46.6-91.4 | | |
| TOTAL KNOWNS (@1 ug/ml) | 2.3 | 28.1 | 2.2 | 13.5 | 3.2 | 60.0 | | |
| Range | 1-5 | 12.5-62.5 | 1-6 | 6.25-37.5 | 2.0-3.6 | 30.5-137.4 | | |
| TOTAL KNOWNS (@10 ug/ml) | 4-8 | 81.3 | 7.8 | 60.9 | 11.1 | 588.2 | | |
| CMV/EBV/Flu | 7 | 87.5 | 12.0 | 50.0 | 4.0 | 59.0 | 4 | 100 |

TABLE 2

Pf-derived A1 supertype peptides with PIC <20 nM

| Malaria locus | Addn Source info | Accession No. | Position | Peptide No. | Sequence | AA | A*0101 PIC | A*0201 PIC | A*1101 PIC | A*2402 PIC |
|---|---|---|---|---|---|---|---|---|---|---|
| 331.t00003 | Chromosome10 | | 216 | 98.0038 | KTNKWEDIY | 9 | 15.962 | 1000000.0 | 1475.7 | 1000000.0 |
| 331.t00003 | Chromosome10 | | 790 | 98.0039 | KSIYIFYTY | 9 | 10.624 | 1000000.0 | 34.6 | 1000000.0 |
| 331.t00003 | Chromosome10 | | 986 | 98.0040 | GTFTFQNMY | 9 | 6.439 | 1000000.0 | 51.0 | 1000000.0 |
| 331.t00003 | Chromosome10 | | 1298 | 98.0041 | CNDGNILYY | 9 | 5.246 | 1000000.0 | 1000000.0 | 1000000.0 |
| 331.t00003 | Chromosome10 | | 1379 | 98.0042 | YFECIMKLY | 9 | 8.786 | 1000000.0 | 39035.2 | 242.6 |
| 331.t00003 | Chromosome10 | | 1389 | 98.0043 | VYEGKLKKY | 9 | 18.802 | 1000000.0 | 1000000.0 | 1753.1 |
| 331.t00003 | Chromosome10 | | 1650 | 98.0001 | VVDLFCGVGY | 10 | 9.498 | 1000000.0 | 153.7 | 1000000.0 |
| 331.t00003 | Chromosome10 | | 1770 | 98.0044 | FSSINTYDY | 9 | 4.161 | 1000000.0 | 4680.1 | 1000000.0 |
| 331.t00003 | Chromosome10 | | 1803 | 98.0045 | VSNVEDSNY | 9 | 18.299 | 1000000.0 | 11308.4 | 1000000.0 |
| 331.t00003 | Chromosome10 | | 1831 | 98.0046 | NSNYNKKLY | 9 | 19.200 | 1000000.0 | 4533.0 | 1000000.0 |
| 18.000811 | Chr12Contig18 | | 182 | 98.0047 | KVSDEIWNY | 9 | 6.117 | 1000000.0 | 40.5 | 1000000.0 |
| MY924Fe3.p1t1 | | | 92 | 98.0048 | ISGEGLIIY | 9 | 4.901 | 1000000.0 | 2464.4 | 1000000.0 |
| MY924Fe3.p1t1 | | | 215 | 98.0002 | FVEDSSSFLY | 10 | 8.740 | 1000000.0 | 445.2 | 1000000.0 |
| MY924Fe3.p1t1 | | | 384 | 98.0049 | DSDSSNVLY | 9 | 7.960 | 1000000.0 | 22156.1 | 1000000.0 |
| MY924Fe3.p1t1 | | | 561 | 98.0050 | SQDVFIIEY | 9 | 6.978 | 1000000.0 | 117.2 | 1000000.0 |
| MY924Fe3.p1t1 | | | 1028 | 98.0051 | NSMFHIIMY | 9 | 4.429 | 1000000.0 | 243.3 | 1000000.0 |
| MY924Fe3.p1t1 | | | 1093 | 98.0052 | SSYNLFEEY | 9 | 6.022 | 1000000.0 | 82.2 | 1000000.0 |
| MY924Fe3.p1t1 | | | 1258 | 98.0053 | SSGKTFICY | 9 | 2.145 | 1000000.0 | 264.3 | 1000000.0 |
| MY924Fe3.p1t1 | | | 1340 | 98.0054 | ILENILLSY | 9 | 3.307 | 1000000.0 | 8368.7 | 1000000.0 |
| MY924Fe3.p1t1 | | | 1439 | 98.0055 | FSDLILYVY | 9 | 2.218 | 1000000.0 | 4308.8 | 1000000.0 |
| MY924Fe3.p1t1 | | | 2318 | 98.0056 | HIENILLKY | 9 | 2.560 | 1000000.0 | 10911.0 | 1000000.0 |
| MP03001 | MAL3P2.11 | CAB38998 | 14 | 98.0057 | FVEALFQEY | 9 | 1.370 | 1000000.0 | 698.4 | 1000000.0 |
| MP03001 | MAL3P2.11 | CAB38998 | 310 | 98.0058 | PSDKHIKEY | 9 | 18.149 | 1000000.0 | 150075.4 | 1000000.0 |
| 1369.t00001 | Chromosome 11 | | 38 | 98.0059 | IMNHLMTLY | 9 | 9.966 | 1000000.0 | 224.2 | 1019.1 |
| 1369.t00001 | Chromosome 11 | | 149 | 98.0060 | LIENELMNY | 9 | 18.117 | 1000000.0 | 15763.1 | 1000000.0 |
| 1369.t00001 | Chromosome 11 | | 182 | 98.0061 | NVDQQNDMY | 9 | 6.934 | 1000000.0 | 6419.6 | 1000000.0 |
| 1369.t00001 | Chromosome 11 | | 309 | 98.0062 | SSFFMNRFY | 9 | 17.546 | 1000000.0 | 48.4 | 1000000.0 |
| 1369.t00001 | Chromosome 11 | | 342 | 98.0063 | NHEQKLSEY | 9 | 16.912 | 1000000.0 | 1000000.0 | 1000000.0 |
| 1369.t00001 | Chromosome 11 | | 347 | 98.0003 | LSEYYDXDIY | 10 | 18.838 | 1000000.0 | 3608.2 | 1000000.0 |
| 1369.t00001 | Chromosome 11 | | 363 | 98.0064 | QEEQKKYIY | 9 | 19.642 | 1000000.0 | 1000000.0 | 1000000.0 |
| 699.t00001 | Chromosome 11 | | 313 | 98.0065 | DSQNELTNY | 9 | 19.647 | 1000000.0 | 97274.6 | 1000000.0 |
| 699.t00001 | Chromosome 11 | | 441 | 98.0004 | FSFFFSLIDY | 10 | 1.491 | 1000000.0 | 319.3 | 1000000.0 |
| 699.t00001 | Chromosome 11 | | 480 | 98.0066 | CHEMKAEFY | 9 | 15.998 | 1000000.0 | 1000000.0 | 1000000.0 |
| 699.t00001 | Chromosome 11 | | 548 | 98.0067 | MFSSIFENY | 9 | 6.908 | 1000000.0 | 1357.8 | 2826.7 |
| 699.t00001 | Chromosome 11 | | 749 | 98.0068 | NSLILLNLY | 9 | 11.791 | 1000000.0 | 4626.8 | 1000000.0 |
| 699.t00001 | Chromosome 11 | | 859 | 98.0069 | YIDNDINIY | 9 | 12.867 | 1000000.0 | 52350.4 | 1000000.0 |
| 699.t00001 | Chromosome 11 | | 919 | 98.0070 | EEDKTYELY | 9 | 13.159 | 1000000.0 | 1000000.0 | 1000000.0 |
| 699.t00001 | Chromosome 11 | | 922 | 98.0071 | KTYELYQKY | 9 | 7.495 | 1000000.0 | 22.4 | 1000000.0 |
| 699.t00001 | Chromosome 11 | | 1013 | 98.0072 | CTHISYYKY | 9 | 14.092 | 1000000.0 | 406.1 | 1000000.0 |
| 699.t00001 | Chromosome 11 | | 1046 | 98.0005 | FVDEEGEQLY | 10 | 6.559 | 1000000.0 | 5771.7 | 1000000.0 |
| M13Hg2.q1t3 | | | 8 | 98.0073 | NSLYNKIEY | 9 | 19.553 | 1000000.0 | 3889.9 | 1000000.0 |
| M13Hg2.q1t3 | | | 46 | 98.0006 | YSSASESNFY | 10 | 12.365 | 1000000.0 | 5058.0 | 1000000.0 |
| M13Hg2.q1t3 | | | 49 | 98.0074 | ASESNFYKY | 9 | 1.848 | 1000000.0 | 630.5 | 1000000.0 |
| M13Hg2.q1t3 | | | 196 | 98.0075 | ASGKLFSLY | 9 | 2.466 | 1000000.0 | 266.9 | 1000000.0 |
| M13Hg2.q1t3 | | | 237 | 98.0076 | GSNKVSDWY | 9 | 16.782 | 1000000.0 | 1646.1 | 1000000.0 |
| M13Hg2.q1t3 | | | 511 | 98.0007 | FQDNYLKLDY | 10 | 7.493 | 1000000.0 | 19742.1 | 1000000.0 |
| M13Hg2.q1t3 | | | 597 | 98.0008 | FFDYNSQYYY | 10 | 19.854 | 1000000.0 | 2749.2 | 1043.1 |
| M13Hg2.q1t3 | | | 597 | 98.0077 | FFDYNSQYY | 9 | 11.735 | 1000000.0 | 3766.2 | 160.3 |

TABLE 2-continued

Pf-derived A1 supertype peptides with PIC <20 nM

| Malaria locus | Addn Source info | Accession No. | Position | Peptide No. | Sequence | AA | A*0101 PIC | PIC A*0201 | A*1101 | A*2402 PIC |
|---|---|---|---|---|---|---|---|---|---|---|
| M13Hg2.q1t3 | | | 699 | 98.0078 | MLEQKLSNY | 9 | 1.204 | 1000000.0 | 13925.8 | 1000000.0 |
| M13Hg2.q1t3 | | | 882 | 98.0079 | NSFNNSNIY | 9 | 16.821 | 1000000.0 | 5231.6 | 1000000.0 |
| Mal_5L10c4.q1t6 | | | 8 | 98.0080 | CSSTKDLNY | 9 | 2.097 | 1000000.0 | 16168.9 | 1000000.0 |
| Mal_5L10c4.q1t6 | | | 263 | 98.0081 | YDDDKYNKY | 9 | 7.997 | 1000000.0 | 98918.2 | 1000000.0 |
| Mal_5L10c4.q1t6 | | | 638 | 98.0082 | GTYGNMENY | 9 | 2.825 | 1000000.0 | 209.0 | 1000000.0 |
| Mal_5L10c4.q1t6 | | | 690 | 98.0083 | FTYYSCKNY | 9 | 6.979 | 1000000.0 | 257.7 | 1000000.0 |
| Mal_5L10c4.q1t6 | | | 1022 | 98.0084 | YDERNTLVY | 9 | 5.181 | 1000000.0 | 47876.1 | 1000000.0 |
| Mal_5L10c4.q1t6 | | | 1387 | 98.0085 | STDDSKNVY | 9 | 4.783 | 1000000.0 | 2220.4 | 1000000.0 |
| Mal_5L10c4.q1t6 | | | 1451 | 98.0086 | FSDDNKNLY | 9 | 2.622 | 1000000.0 | 56737.7 | 1000000.0 |
| Mal_5L10c4.q1t6 | | | 1508 | 98.0009 | YLDNELTINY | 10 | 6.162 | 1000000.0 | 7177.6 | 1000000.0 |
| Mal_5L10c4.q1t6 | | | 1709 | 98.0087 | STTSLNYHY | 9 | 7.670 | 1000000.0 | 19.1 | 1000000.0 |
| Mal_5L10c4.q1t6 | | | 1907 | 98.0088 | GLDLKMTLY | 9 | 2.747 | 1000000.0 | 5170.0 | 1000000.0 |
| 571.t00003 | Chromosome11 | | 1044 | 98.0010 | YTFQNNNDFY | 10 | 2.179 | 1000000.0 | 93.5 | 1000000.0 |
| 571.t00003 | Chromosome11 | | 1080 | 98.0089 | HTNNKTSIY | 9 | 4.189 | 1000000.0 | 1677.3 | 1000000.0 |
| 571.t00003 | Chromosome11 | | 1710 | 98.0090 | FVDPNKYIY | 9 | 2.171 | 1000000.0 | 6898.3 | 1000000.0 |
| 571.t00003 | Chromosome11 | | 1827 | 98.0011 | NVEAYHNDNY | 10 | 5.835 | 1000000.0 | 1804.6 | 1000000.0 |
| 571.t00003 | Chromosome11 | | 1858 | 98.0091 | YSNNSHAEY | 9 | 7.282 | 1000000.0 | 662.3 | 1000000.0 |
| 571.t00003 | Chromosome11 | | 1905 | 98.0092 | LTNNSSYIY | 9 | 7.415 | 1000000.0 | 186.2 | 1000000.0 |
| 571.t00003 | Chromosome11 | | 2211 | 98.0093 | SSSIYNQNY | 9 | 6.330 | 1000000.0 | 318.5 | 1000000.0 |
| 571.t00003 | Chromosome11 | | 2476 | 98.0094 | GSYGTFLKY | 9 | 1.127 | 1000000.0 | 151.7 | 1000000.0 |
| 571.t00003 | Chromosome11 | | 2532 | 98.0095 | DIDKTVLHY | 9 | 4.678 | 1000000.0 | 10960.5 | 1000000.0 |
| 571.t00003 | Chromosome11 | | 2571 | 98.0012 | FNDTQKKGTY | 10 | 7.668 | 1000000.0 | 1000000.0 | 1000000.0 |
| MP03072 | PFC0450w | CAA15614 | 95 | 98.0013 | LSASDEYEQY | 10 | 14.664 | 1000000.0 | 11938.7 | 1000000.0 |
| MP03072 | PFC0450w | CAA15614 | 96 | 98.0096 | SASDEYEQY | 9 | 16.603 | 1000000.0 | 163.8 | 1000000.0 |
| 45.t00001 | Chromosome14 | | 13 | 98.0014 | FQAAESNERY | 10 | 13.667 | 1000000.0 | 5804.6 | 1000000.0 |
| 45.t00001 | Chromosome14 | | 14 | 98.0097 | QAAESNERY | 9 | 7.537 | 1000000.0 | 4581.2 | 1000000.0 |
| 45.t00001 | Chromosome14 | | 81 | 98.0015 | ELEASISGKY | 10 | 17.550 | 1000000.0 | 30954.5 | 1000000.0 |
| 45.t00001 | Chromosome14 | | 82 | 98.0098 | LEASISGKY | 9 | 18.208 | 1000000.0 | 1000000.0 | 1000000.0 |
| 45.t00001 | Chromosome14 | | 188 | 98.0099 | NLALLYGEY | 9 | 12.836 | 1000000.0 | 4104.6 | 1000000.0 |
| MP03137 | PFC0700c | CAB11150 | 14 | 98.0100 | SSPLFNNFY | 9 | 20.002 | 1000000.0 | 464.0 | 1000000.0 |
| MP03137 | PFC0700c | CAB11150 | 69 | 98.0101 | LNEQLIYTY | 9 | 10.436 | 1000000.0 | 1000000.0 | 1000000.0 |
| MP03137 | PFC0700c | CAB11150 | 145 | 98.0102 | QNADKNFLY | 9 | 10.234 | 1000000.0 | 1000000.0 | 1000000.0 |
| MP03137 | PFC0700c | CAB11150 | 255 | 98.0016 | FVSSIFISFY | 10 | 10.460 | 1000000.0 | 44.6 | 1000000.0 |
| MP03137 | PFC0700c | CAB11150 | 256 | 98.0103 | VSSIFISFY | 9 | 15.732 | 1000000.0 | 544.5 | 1000000.0 |
| 12.t00018 | Chromosome14 | | 112 | 98.0104 | YSYYEPLRY | 9 | 4.229 | 1000000.0 | 560.9 | 1000000.0 |
| 12.t00018 | Chromosome14 | | 250 | 98.0017 | KSNNIIPLLY | 10 | 8.533 | 1000000.0 | 967.3 | 1000000.0 |
| 12.t00018 | Chromosome14 | | 467 | 98.0105 | SSSDEENLY | 9 | 8.006 | 1000000.0 | 2243.6 | 1000000.0 |
| 12.t00018 | Chromosome14 | | 468 | 98.0106 | SSDEENLYY | 9 | 6.105 | 1000000.0 | 64.6 | 1000000.0 |
| 12.t00018 | Chromosome14 | | 607 | 98.0107 | KSNMNNNLY | 9 | 6.927 | 1000000.0 | 923.1 | 1000000.0 |
| 12.t00018 | Chromosome14 | | 626 | 98.0108 | FYDKRFIFY | 9 | 4.639 | 1000000.0 | 1000000.0 | 18.3 |
| 12.t00018 | Chromosome14 | | 696 | 98.0018 | NVEKNFLLYY | 10 | 7.724 | 1000000.0 | 328.7 | 1000000.0 |
| 12.t00018 | Chromosome14 | | 696 | 98.0109 | NVEKNFLLY | 9 | 0.789 | 1000000.0 | 1330.7 | 1000000.0 |
| 12.t00018 | Chromosome14 | | 949 | 98.0110 | KMDSFLNVY | 9 | 6.016 | 1000000.0 | 1384.3 | 151.9 |
| 12.t00018 | Chromosome14 | | 1042 | 98.0111 | NSLIEFLFY | 9 | 9.105 | 1000000.0 | 774.9 | 1000000.0 |
| mal_BU121g9.q1c1 | | | 80 | 98.0112 | ATYKNGNIY | 9 | 3.423 | 1000000.0 | 290.6 | 1000000.0 |
| mal_9A57b11.q1t2 | | | 226 | 98.0113 | DEEKIFVKY | 9 | 18.436 | 1000000.0 | 1000000.0 | 1000000.0 |
| mal_BL50e8.p1ca_5 | | | 86 | 98.0114 | HTSNDSGSY | 9 | 7.801 | 1000000.0 | 10632.6 | 1000000.0 |
| mal_BL50e8.p1ca_5 | | | 136 | 98.0019 | FSFTVGEGKY | 10 | 4.464 | 1000000.0 | 4191.1 | 1000000.0 |
| mal_BL50e8.p1ca_5 | | | 186 | 98.0115 | ETNNNLFIY | 9 | 3.940 | 1000000.0 | 574.3 | 1000000.0 |
| mal_BL50e8.p1ca_5 | | | 319 | 98.0116 | HVSKHAFEY | 9 | 3.473 | 1000000.0 | 286.4 | 1000000.0 |
| mal_BL50e8.p1ca_5 | | | 387 | 98.0117 | MSGYSSNNY | 9 | 4.983 | 1000000.0 | 1178.7 | 1000000.0 |
| mal_BL50e8.p1ca_5 | | | 460 | 98.0118 | FMESAFVNY | 9 | 2.609 | 1000000.0 | 3568.1 | 1208.1 |
| mal_BL50e8.p1ca_5 | | | 650 | 98.0119 | RSPCSHKLY | 9 | 6.243 | 1000000.0 | 805.6 | 1000000.0 |
| mal_BL50e8.p1ca_5 | | | 679 | 98.0020 | FTGENNIERY | 10 | 15.909 | 1000000.0 | 1908.1 | 1000000.0 |
| mal_BL50e8.p1ca_5 | | | 777 | 98.0120 | NTLMLKADY | 9 | 15.648 | 1000000.0 | 6774.7 | 1000000.0 |
| mal_BL50e8.p1ca_5 | | | 880 | 98.0121 | VSSKPANEY | 9 | 15.176 | 1000000.0 | 3405.9 | 1000000.0 |
| M13S8h6.p1t_3 | | | 57 | 98.0122 | ITYSFTVSY | 9 | 10.960 | 1000000.0 | 25.1 | 1000000.0 |
| M13S8h6.p1t_3 | | | 233 | 98.0123 | LVETLDNLY | 9 | 3.907 | 1000000.0 | 24044.7 | 1000000.0 |
| M13S8h6.p1t_3 | | | 235 | 98.0124 | ETLDNLYLY | 9 | 2.901 | 1000000.0 | 801.6 | 1000000.0 |
| M13S8h6.p1t_3 | | | 295 | 98.0125 | LSAKYYISY | 9 | 4.669 | 1000000.0 | 635.7 | 1000000.0 |
| M13S8h6.p1t_3 | | | 551 | 98.0126 | HSDIHLLNY | 9 | 1.423 | 1000000.0 | 5008.9 | 1000000.0 |
| M13S8h6.p1t_3 | | | 676 | 98.0021 | FTSPVNIKEY | 10 | 10.972 | 1000000.0 | 1911.2 | 1000000.0 |
| M13S8h6.p1t_3 | | | 746 | 98.0127 | YSSYSSPKY | 9 | 5.286 | 1000000.0 | 6184.9 | 1000000.0 |
| M13S8h6.p1t_3 | | | 898 | 98.0128 | GMERNKTKY | 9 | 7.244 | 1000000.0 | 88038.7 | 24764.5 |
| M13S8h6.p1t_3 | | | 1268 | 98.0129 | YSNIDSGKY | 9 | 11.517 | 1000000.0 | 14325.6 | 1000000.0 |
| M13S8h6.p1t_3 | | | 1488 | 98.0130 | LIDLSCIHY | 9 | 3.960 | 1000000.0 | 1722.8 | 1000000.0 |
| 585.t00002 | Chromosome11 | | 297 | 98.0131 | CSDSSLNIY | 9 | 2.643 | 1000000.0 | 44436.7 | 1000000.0 |
| 585.t00002 | Chromosome11 | | 381 | 98.0132 | VSFDNNENY | 9 | 7.080 | 1000000.0 | 824.4 | 1000000.0 |
| 585.t00002 | Chromosome11 | | 465 | 98.0022 | YTDIIINIRY | 10 | 1.851 | 1000000.0 | 1716.6 | 1000000.0 |
| 585.t00002 | Chromosome11 | | 575 | 98.0023 | LSNIRKPLFY | 10 | 5.132 | 1000000.0 | 3669.8 | 1000000.0 |
| 585.t00002 | Chromosome11 | | 741 | 98.0133 | NVDANYCKY | 9 | 3.822 | 1000000.0 | 813.1 | 1000000.0 |
| 585.t00002 | Chromosome11 | | 1021 | 98.0134 | CVEKNNMSY | 9 | 6.497 | 1000000.0 | 33246.6 | 1000000.0 |
| 585.t00002 | Chromosome11 | | 1161 | 98.0135 | SSDGKKSEY | 9 | 5.530 | 1000000.0 | 8369.5 | 1000000.0 |

TABLE 2-continued

Pf-derived A1 supertype peptides with PIC <20 nM

| Malaria locus | Addn Source info | Accession No. | Position | Peptide No. | Sequence | AA | A*0101 PIC | A*0201 PIC | A*1101 PIC | A*2402 PIC |
|---|---|---|---|---|---|---|---|---|---|---|
| 585.t00002 | Chromosome11 | | 1219 | 98.0136 | RSNNFFFSY | 9 | 6.117 | 1000000.0 | 11.9 | 1000000.0 |
| 585.t00002 | Chromosome11 | | 1361 | 98.0024 | FTMVYEKIKY | 10 | 2.669 | 1000000.0 | 726.8 | 1000000.0 |
| 585.t00002 | Chromosome11 | | 1739 | 98.0137 | NVDIFLHYY | 9 | 3.691 | 1000000.0 | 42.6 | 1000000.0 |
| 1223.t00015 | mal_9A21f9.q1t_4 | | 387 | 98.0138 | SSNEIHNFY | 9 | 7.488 | 1000000.0 | 19.5 | 1000000.0 |
| 1223.t00015 | mal_9A21f9.q1t_4 | | 1065 | 98.0139 | GTKLNRTKY | 9 | 6.438 | 1000000.0 | 9805.4 | 1000000.0 |
| 1223.t00015 | mal_9A21f9.q1t_4 | | 1583 | 98.0025 | ATVSRAGIVY | 10 | 9.716 | 1000000.0 | 351.9 | 1000000.0 |
| 1223.t00015 | mal_9A21f9.q1t_4 | | 1833 | 98.0140 | YTLSSGTKY | 9 | 4.847 | 1000000.0 | 1878.1 | 1000000.0 |
| 1223.t00015 | mal_9A21f9.q1t_4 | | 2309 | 98.0141 | VSEKEQQLY | 9 | 6.585 | 1000000.0 | 56024.7 | 1000000.0 |
| 1223.t00015 | mal_9A21f9.q1t_4 | | 2426 | 98.0142 | VVDFERLRY | 9 | 3.185 | 1000000.0 | 457.2 | 1000000.0 |
| 1223.t00015 | mal_9A21f9.q1t_4 | | 2778 | 98.0143 | FIDLYKQMY | 9 | 5.792 | 1000000.0 | 14889.5 | 1000000.0 |
| 1223.t00015 | mal_9A21f9.q1t_4 | | 3445 | 98.0144 | IVDITNVNY | 9 | 6.389 | 1000000.0 | 1065.1 | 1000000.0 |
| 1223.t00015 | mal_9A21f9.q1t_4 | | 4163 | 98.0145 | LEDVKKILY | 9 | 9.183 | 1000000.0 | 1000000.0 | 1000000.0 |
| 1223.t00015 | mal_9A21f9.q1t_4 | | 4267 | 98.0146 | SLDIPDIAY | 9 | 9.566 | 1000000.0 | 1095.4 | 1000000.0 |
| 599.t00001 | Chromosome11 | | 26 | 98.0147 | SSCQNSLNY | 9 | 1.030 | 1000000.0 | 86.7 | 1000000.0 |
| 599.t00001 | Chromosome11 | | 183 | 98.0148 | KSDITNLNY | 9 | 4.923 | 1000000.0 | 947.1 | 1000000.0 |
| 599.t00001 | Chromosome11 | | 304 | 98.0149 | ETNNGDLKY | 9 | 6.392 | 1000000.0 | 6561.2 | 1000000.0 |
| 599.t00001 | Chromosome11 | | 430 | 98.0150 | LSEDNKNRY | 9 | 7.171 | 1000000.0 | 178412.8 | 1000000.0 |
| 599.t00001 | Chromosome11 | | 1018 | 98.0026 | LLDLRKNGLY | 10 | 3.696 | 1000000.0 | 12286.3 | 1000000.0 |
| 599.t00001 | Chromosome11 | | 1412 | 98.0027 | GVDKSLKIMY | 10 | 8.185 | 1000000.0 | 3010.4 | 1000000.0 |
| 599.t00001 | Chromosome11 | | 1427 | 98.0151 | YTPTNKEMY | 9 | 6.553 | 1000000.0 | 73406.9 | 1000000.0 |
| 599.t00001 | Chromosome11 | | 1516 | 98.0028 | ESANDSTNYY | 10 | 6.672 | 1000000.0 | 2007.1 | 1000000.0 |
| 599.t00001 | Chromosome11 | | 1662 | 98.0152 | LSNSITVSY | 9 | 9.278 | 1000000.0 | 771.6 | 1000000.0 |
| 599.t00001 | Chromosome11 | | 1902 | 98.0153 | GTTQSNNIY | 9 | 3.444 | 1000000.0 | 4003.2 | 1000000.0 |
| MP01072 | M1045c5.p1c.C_6 | | 27 | 98.0154 | SDDEIIIIY | 9 | 11.359 | 1000000.0 | 1265.6 | 1000000.0 |
| MP01072 | M1045c5.p1c.C_6 | | 41 | 98.0155 | ISSNGKLNY | 9 | 6.926 | 1000000.0 | 2877.4 | 1000000.0 |
| MP01072 | M1045c5.p1c.C_6 | | 60 | 98.0156 | GSIQNAYLY | 9 | 2.697 | 1000000.0 | 389.5 | 1000000.0 |
| MP01072 | M1045c5.p1c.C_6 | | 381 | 98.0157 | GTMRNRKKY | 9 | 1.998 | 1000000.0 | 249.1 | 1000000.0 |
| MP01072 | M1045c5.p1c.C_6 | | 707 | 98.0158 | KSLLKNYNY | 9 | 15.958 | 1000000.0 | 419.1 | 1000000.0 |
| MP01072 | M1045c5.p1c.C_6 | | 725 | 98.0159 | NVEDTNMLY | 9 | 9.314 | 1000000.0 | 3255.6 | 1000000.0 |
| MP01072 | M1045c5.p1c.C_6 | | 1065 | 98.0029 | NTDNKDVLNY | 10 | 6.923 | 1000000.0 | 6127.0 | 1000000.0 |
| MP01072 | M1045c5.p1c.C_6 | | 1253 | 98.0160 | HTITISQKY | 9 | 3.528 | 1000000.0 | 4947.2 | 1000000.0 |
| MP01072 | M1045c5.p1c.C_6 | | 1257 | 98.0161 | ISQKYTSSY | 9 | 13.157 | 1000000.0 | 5019.1 | 1000000.0 |
| MP01072 | M1045c5.p1c.C_6 | | 1336 | 98.0030 | KTFHRILAVY | 10 | 13.836 | 1000000.0 | 85.1 | 1000000.0 |
| PIR2 | T28161 | | 228 | 98.0162 | KTNGAEERY | 9 | 8.691 | 1000000.0 | 326.3 | 1000000.0 |
| PIR2 | T28161 | | 293 | 98.0163 | GTVPTNLDY | 9 | 3.979 | 1000000.0 | 793.4 | 1000000.0 |
| PIR2 | T28161 | | 403 | 98.0031 | ESSQNSPKNY | 10 | 8.536 | 1000000.0 | 24883.8 | 1000000.0 |
| PIR2 | T28161 | | 639 | 98.0032 | QTDFQGWGHY | 10 | 2.601 | 1000000.0 | 1349.4 | 1000000.0 |
| PIR2 | T28161 | | 899 | 98.0164 | EADFIKKMY | 9 | 9.348 | 1000000.0 | 113941.0 | 1000000.0 |
| PIR2 | T28161 | | 917 | 98.0165 | ATICRAMKY | 9 | 5.412 | 1000000.0 | 112.4 | 1000000.0 |
| PIR2 | T28161 | | 1192 | 98.0033 | KTDEQYNENY | 10 | 5.386 | 1000000.0 | 1911.8 | 1000000.0 |
| PIR2 | T28161 | | 1201 | 98.0034 | YTFKNPPPQY | 10 | 8.064 | 1000000.0 | 918.8 | 1000000.0 |
| PIR2 | T28161 | | 1884 | 98.0166 | WLEYFLDDY | 9 | 8.602 | 1000000.0 | 35096.0 | 1000000.0 |
| PIR2 | T28161 | | 2221 | 98.0167 | ITSSSESEY | 9 | 9.299 | 1000000.0 | 1168.0 | 1000000.0 |
| 55.t00004 | Chromosome14 | | 45 | 98.0168 | YVDIGSNIY | 9 | 3.352 | 1000000.0 | 18704.2 | 1000000.0 |
| 55.t00004 | Chromosome14 | | 457 | 98.0169 | DTCKNIWNY | 9 | 3.842 | 1000000.0 | 878.3 | 1000000.0 |
| 55.t00004 | Chromosome14 | | 563 | 98.0170 | LSQGKKNTY | 9 | 10.561 | 1000000.0 | 40514.9 | 1000000.0 |
| 55.t00004 | Chromosome14 | | 928 | 98.0171 | NIDCVISPY | 9 | 8.449 | 1000000.0 | 3464.1 | 1000000.0 |
| 55.t00004 | Chromosome14 | | 953 | 98.0172 | NMDNLLFTY | 9 | 5.144 | 1000000.0 | 413.3 | 6464.5 |
| 55.t00004 | Chromosome14 | | 1105 | 98.0035 | FVDHNYNYNY | 10 | 6.601 | 1000000.0 | 687.9 | 1000000.0 |
| 55.t00004 | Chromosome14 | | 1261 | 98.0173 | HSKENQQKY | 9 | 3.798 | 1000000.0 | 41445.3 | 1000000.0 |
| 55.t00004 | Chromosome14 | | 1339 | 98.0174 | VSEGYTSTY | 9 | 7.735 | 1000000.0 | 4760.1 | 1000000.0 |
| 55.t00004 | Chromosome14 | | 1358 | 98.0175 | FMDSQNGMY | 9 | 8.455 | 1000000.0 | 21913.6 | 2720.6 |
| 55.t00004 | Chromosome14 | | 1537 | 98.0036 | NSYNDSLINY | 10 | 12.536 | 1000000.0 | 1846.9 | 1000000.0 |
| 13.t00011 | Chromosome14 | | 27 | 98.0176 | STGINEENY | 9 | 6.590 | 1000000.0 | 838.9 | 1000000.0 |
| 13.t00011 | Chromosome14 | | 44 | 98.0177 | MNETVFLDY | 9 | 5.456 | 1000000.0 | 1000000.0 | 1000000.0 |
| 13.t00011 | Chromosome14 | | 77 | 98.0178 | LTSKVWDTY | 9 | 6.496 | 1000000.0 | 616.6 | 1000000.0 |
| 37.t00002 | Chromosome14 | | 10 | 98.0179 | KHDALTYMY | 9 | 23.541 | 1000000.0 | 1000000.0 | 1000000.0 |
| 37.t00002 | Chromosome14 | | 14 | 98.0180 | LTYMYCVYY | 9 | 10.044 | 1000000.0 | 20.3 | 1000000.0 |
| 674.t00001 | Chromosome11 | | 201 | 98.0181 | NIDINDLGY | 9 | 10.069 | 1000000.0 | 23874.2 | 1000000.0 |
| 674.t00001 | Chromosome11 | | 260 | 98.0182 | ISSNQFNNY | 9 | 6.099 | 1000000.0 | 2575.9 | 1000000.0 |
| 674.t00001 | Chromosome11 | | 400 | 98.0183 | DIEPLISSY | 9 | 14.646 | 1000000.0 | 183727.1 | 1000000.0 |
| 674.t00001 | Chromosome11 | | 453 | 98.0037 | VTNNDSINNY | 10 | 17.920 | 1000000.0 | 1310.7 | 1000000.0 |
| 674.t00001 | Chromosome11 | | 772 | 98.0184 | ESGKNMEHY | 9 | 8.198 | 1000000.0 | 75390.5 | 1000000.0 |
| 674.t00001 | Chromosome11 | | 868 | 98.0185 | LKDFDMLLY | 9 | 12.047 | 1000000.0 | 1000000.0 | 1000000.0 |
| 674.t00001 | Chromosome11 | | 936 | 98.0186 | YIDVEDDDY | 9 | 13.870 | 1000000.0 | 377275.0 | 1000000.0 |
| 674.t00001 | Chromosome11 | | 1001 | 98.0187 | DMDDNYYLY | 9 | 3.056 | 1000000.0 | 2478.6 | 45380.9 |
| 674.t00001 | Chromosome11 | | 1224 | 98.0188 | YGDNNKDCY | 9 | 19.772 | 1000000.0 | 368191.0 | 1000000.0 |
| 674.t00001 | Chromosome11 | | 1239 | 98.0189 | IYDFNNNSY | 9 | 17.735 | 1000000.0 | 1000000.0 | 365.4 |

TABLE 3

Pf-derived A24 supertype peptides with PIG <100 nM

| | | | | | | | PIC | | | |
|---|---|---|---|---|---|---|---|---|---|---|
| Malaria locus | Addn Source info | Accession No. | Position | Peptide No. | Sequence | AA | A*0101 PIC | A*0201 | A*1101 | A*2402 PIC |
| 331.t00003 | Chromosome10 | | 10 | 98.0206 | FYKKKRNVL | 9 | 67134.0 | 1000000.0 | 1000000.0 | 1.708 |
| 331.t00003 | Chromosome10 | | 110 | 98.0207 | VYEINKNEF | 9 | 84.1 | 1000000.0 | 1000000.0 | 2.011 |
| 331.t00003 | Chromosome10 | | 604 | 98.0208 | FFVWGHDMF | 9 | 221.0 | 1000000.0 | 1000000.0 | 3.642 |
| 331.t00003 | Chromosome10 | | 684 | 98.0209 | VYNIKENFW | 9 | 123239.4 | 1000000.0 | 1000000.0 | 2.687 |
| 331.t00003 | Chromosome10 | | 1108 | 98.0210 | KYNLCHNML | 9 | 147073.6 | 1000000.0 | 1000000.0 | 0.324 |
| 331.t00003 | Chromosome10 | | 1268 | 98.0211 | FYVPIKKKL | 9 | 172677.3 | 1000000.0 | 1000000.0 | 2.705 |
| 331.t00003 | Chromosome10 | | 1365 | 98.0212 | KYEIIGNIL | 9 | 89209.4 | 1000000.0 | 1000000.0 | 1.961 |
| 331.t00003 | Chromosome10 | | 1449 | 98.0213 | FWLAIKDIF | 9 | 173.9 | 1000000.0 | 1000000.0 | 1.093 |
| 331.t00003 | Chromosome10 | | 1515 | 98.0214 | LYRRRKNLF | 9 | 113.5 | 1000000.0 | 1000000.0 | 1.220 |
| 331.t00003 | Chromosome10 | | 1704 | 98.0215 | IYIIKQNSF | 9 | 111.6 | 1000000.0 | 1000000.0 | 0.256 |
| 18.000811 | Chr12Contig18 | | 5 | 98.0190 | LFVCFLIFHF | 10 | 672.3 | 1000000.0 | 1000000.0 | 19.783 |
| 18.000811 | Chr12Contig18 | | 8 | 98.0191 | CFLIFHFFLF | 10 | 1385.7 | 1000000.0 | 1000000.0 | 18.444 |
| 18.000811 | Chr12Contig18 | | 8 | 98.0216 | CFLIFHFFL | 9 | 106491.6 | 1000000.0 | 1000000.0 | 0.321 |
| 18.000811 | Chr12Contig18 | | 11 | 98.0217 | IFHFFLFLL | 9 | 53306.2 | 1000000.0 | 1000000.0 | 38.527 |
| 18.000811 | Chr12Contig18 | | 13 | 98.0192 | HFFLFLLYIL | 10 | 1000000.0 | 1000000.0 | 1000000.0 | 35.659 |
| 18.000811 | Chr12Contig18 | | 13 | 98.0218 | HFFLFLLYI | 9 | 24845.8 | 1000000.0 | 1000000.0 | 26.159 |
| 18.000811 | Chr12Contig18 | | 14 | 98.0219 | FFLFLLYIL | 9 | 62569.1 | 1000000.0 | 1000000.0 | 32.471 |
| 18.000811 | Chr12Contig18 | | 19 | 98.0220 | LYILFLVKM | 9 | 90645.8 | 1000000.0 | 1000000.0 | 63.051 |
| 18.000811 | Chr12Contig18 | | 41 | 98.0221 | VFLVFSNVL | 9 | 178682.3 | 1000000.0 | 1000000.0 | 5.555 |
| 18.000811 | Chr12Contig18 | | 160 | 98.0222 | TYGIIVPVL | 9 | 123562.9 | 1000000.0 | 1000000.0 | 3.015 |
| MY924Fe3.p1t1 | | | 153 | 98.0223 | FFNVFNIFF | 9 | 45.6 | 1000000.0 | 1000000.0 | 0.470 |
| MY924Fe3.p1t1 | | | 1412 | 98.0224 | FYSWLQNVL | 9 | 83170.3 | 1000000.0 | 1000000.0 | 2.428 |
| MY924Fe3.p1t1 | | | 1435 | 98.0225 | FYERFSDLI | 9 | 46149.1 | 1000000.0 | 1000000.0 | 0.625 |
| MY924Fe3.p1t1 | | | 1534 | 98.0226 | VYLIQNNYI | 9 | 615175.4 | 1000000.0 | 1000000.0 | 0.632 |
| MY924Fe3.p1t1 | | | 1557 | 98.0227 | NYMKNSFYI | 9 | 24802.7 | 1000000.0 | 1000000.0 | 2.200 |
| MY924Fe3.p1t1 | | | 1800 | 98.0228 | VYCNYVTEI | 9 | 160654.7 | 1000000.0 | 1000000.0 | 3.071 |
| MY924Fe3.p1t1 | | | 1839 | 98.0229 | HYEVLPYKF | 9 | 14.6 | 1000000.0 | 1000000.0 | 2.621 |
| MY924Fe3.p1t1 | | | 1846 | 98.0230 | KFTIIVESL | 9 | 181796.5 | 1000000.0 | 1000000.0 | 1.946 |
| MY924Fe3.p1t1 | | | 2159 | 98.0231 | FMTRAHFHI | 9 | 9020.6 | 52.2 | 1000000.0 | 1.455 |
| MY924Fe3.p1t1 | | | 2380 | 98.0232 | FYKSKVIII | 9 | 53263.7 | 1000000.0 | 1000000.0 | 0.928 |
| MP03001 | MAL3P2.11 | CAB38998 | 11 | 98.0233 | SFLFVEALF | 9 | 80.3 | 1000000.0 | 1000000.0 | 53.045 |
| MP03001 | MAL3P2.11 | CAB38998 | 54 | 98.0234 | YYGKQENWY | 9 | 73.1 | 1000000.0 | 1000000.0 | 49.750 |
| MP03001 | MAL3P2.11 | CAB38998 | 369 | 98.0235 | KMEKCSSVF | 9 | 34.0 | 1000000.0 | 1000000.0 | 39.989 |
| MP03001 | MAL3P2.11 | CAB38998 | 376 | 98.0236 | VFNVVNSSI | 9 | 231723.5 | 1000000.0 | 1000000.0 | 82.506 |
| 1369.t00001 | Chromosome 11 | | 34 | 98.0237 | NYMKIMNHL | 9 | 37582.2 | 1000000.0 | 1000000.0 | 4.875 |
| 1369.t00001 | Chromosome 11 | | 225 | 98.0193 | SYKSSKRDKF | 10 | 1632.7 | 1000000.0 | 1000000.0 | 46.746 |
| 1369.t00001 | Chromosome 11 | | 264 | 98.0238 | TYKKKNNHI | 9 | 90904.7 | 1000000.0 | 1000000.0 | 12.042 |
| 1369.t00001 | Chromosome 11 | | 277 | 98.0239 | VYYNILIVL | 9 | 59837.4 | 1000000.0 | 1000000.0 | 11.637 |
| 1369.t00001 | Chromosome 11 | | 285 | 98.0240 | LYYLFNQHI | 9 | 56431.2 | 1000000.0 | 1000000.0 | 5.598 |
| 1369.t00001 | Chromosome 11 | | 310 | 98.0241 | SFFMNRFYI | 9 | 56480.3 | 1000000.0 | 1000000.0 | 80.940 |
| 1369.t00001 | Chromosome 11 | | 316 | 98.0242 | FYITTRYKY | 9 | 45.2 | 1000000.0 | 1000000.0 | 3.968 |
| 1369.t00001 | Chromosome 11 | | 328 | 98.0243 | KYINFINFI | 9 | 289163.4 | 1000000.0 | 1000000.0 | 0.095 |
| 1369.t00001 | Chromosome 11 | | 331 | 98.0244 | NFINFIKVL | 9 | 610070.5 | 1000000.0 | 1000000.0 | 37.188 |
| 1369.t00001 | Chromosome 11 | | 380 | 98.0245 | KYEALIKLL | 9 | 105887.8 | 1000000.0 | 1000000.0 | 9.605 |
| 699.t00001 | Chromosome 11 | | 443 | 98.0246 | FFFSLIDYF | 9 | 118.9 | 1000000.0 | 1000000.0 | 1.331 |
| 699.t00001 | Chromosome 11 | | 460 | 98.0247 | KYNIKVCEL | 9 | 98354.1 | 1000000.0 | 1000000.0 | 0.429 |
| 699.t00001 | Chromosome 11 | | 487 | 98.0248 | FYLYISFLL | 9 | 34312.8 | 1000000.0 | 1000000.0 | 0.417 |
| 699.t00001 | Chromosome 11 | | 664 | 98.0249 | FYTNNANLL | 9 | 42910.8 | 1000000.0 | 1000000.0 | 0.639 |
| 699.t00001 | Chromosome 11 | | 766 | 98.0250 | EYNPSFFYL | 9 | 22929.4 | 1000000.0 | 1000000.0 | 1.772 |
| 699.t00001 | Chromosome 11 | | 845 | 98.0251 | SFIIFKNIF | 9 | 249.9 | 1000000.0 | 1000000.0 | 3.449 |
| 699.t00001 | Chromosome 11 | | 881 | 98.0252 | LYMNFLKFI | 9 | 34148.2 | 1000000.0 | 1000000.0 | 4.363 |
| 699.t00001 | Chromosome 11 | | 929 | 98.0253 | KYLIILLYI | 9 | 93640.1 | 1000000.0 | 1000000.0 | 1.034 |
| 699.t00001 | Chromosome 11 | | 1020 | 98.0254 | KYIYIYIYI | 9 | 215740.5 | 1000000.0 | 1000000.0 | 0.296 |
| 699.t00001 | Chromosome 11 | | 1024 | 98.0255 | IYIYIFIYL | 9 | 52331.1 | 1000000.0 | 1000000.0 | 2.300 |
| M13Hg2.q1t3 | | | 135 | 98.0256 | IYINKLSFF | 9 | 67.4 | 1000000.0 | 1000000.0 | 3.329 |
| M13Hg2.q1t3 | | | 142 | 98.0257 | FFSIKDELF | 9 | 27.2 | 1000000.0 | 1000000.0 | 14.276 |
| M13Hg2.q1t3 | | | 156 | 98.0258 | EFLKNNSYF | 9 | 164.9 | 1000000.0 | 1000000.0 | 20.204 |
| M13Hg2.q1t3 | | | 163 | 98.0259 | YFNIIQQKI | 9 | 45274.1 | 1000000.0 | 1000000.0 | 13.888 |
| M13Hg2.q1t3 | | | 244 | 98.0260 | WYCSACNFL | 9 | 56993.5 | 1000000.0 | 1000000.0 | 7.339 |
| M13Hg2.q1t3 | | | 296 | 98.0261 | LYLINNKNL | 9 | 150801.1 | 1000000.0 | 1000000.0 | 28.854 |
| M13Hg2.q1t3 | | | 345 | 98.0262 | TYKDANNNI | 9 | 71978.1 | 1000000.0 | 1000000.0 | 29.035 |
| M13Hg2.q1t3 | | | 521 | 98.0263 | VYEKEKQYF | 9 | 103.6 | 1000000.0 | 1000000.0 | 3.963 |
| M13Hg2.q1t3 | | | 553 | 98.0194 | PYFNFFVNYF | 10 | 185.8 | 1000000.0 | 1000000.0 | 33.503 |
| M13Hg2.q1t3 | | | 889 | 98.0264 | IYNNNNEHI | 9 | 77962.6 | 1000000.0 | 1000000.0 | 24.919 |
| Mal_5L10c4.q1t6 | | | 78 | 98.0265 | EYNKYNEYF | 9 | 90.4 | 1000000.0 | 1000000.0 | 3.130 |
| Mal_5L10c4.q1t6 | | | 137 | 98.0266 | NYVNNNNVF | 9 | 220.5 | 1000000.0 | 1000000.0 | 3.441 |
| Mal_5L10c4.q1t6 | | | 321 | 98.0267 | KYPIKYCEL | 9 | 183114.8 | 1000000.0 | 1000000.0 | 0.364 |
| Mal_5L10c4.q1t6 | | | 416 | 98.0268 | AYHDLIKLF | 9 | 66.8 | 1000000.0 | 1000000.0 | 4.671 |
| Mal_5L10c4.q1t6 | | | 533 | 98.0269 | KYISSVNYF | 9 | 194.8 | 1000000.0 | 1000000.0 | 0.018 |
| Mal_5L10c4.q1t6 | | | 773 | 98.0270 | KYDWFFNSF | 9 | 34.0 | 1000000.0 | 1000000.0 | 0.374 |
| Mal_5L10c4.q1t6 | | | 1183 | 98.0271 | HYVIKKYII | 9 | 133499.1 | 1000000.0 | 1000000.0 | 1.507 |
| Mal_5L10c4.q1t6 | | | 1259 | 98.0272 | LYLHIHKLF | 9 | 72.0 | 1000000.0 | 1000000.0 | 0.343 |
| Mal_5L10c4.q1t6 | | | 1323 | 98.0273 | YYRTNYGYI | 9 | 165642.6 | 1000000.0 | 1000000.0 | 4.072 |

TABLE 3-continued

Pf-derived A24 supertype peptides with PIG <100 nM

| | | | | | | | PIC | | | |
|---|---|---|---|---|---|---|---|---|---|---|
| Malaria locus | Addn Source info | Accession No. | Position | Peptide No. | Sequence | AA | A*0101 PIC | A*0201 | A*1101 | A*2402 PIC |
| Mal_5L10c4.q1t6 | | | 2054 | 98.0274 | KYLRYHSQL | 9 | 421667.1 | 1000000.0 | 1000000.0 | 0.655 |
| 571.t00003 | Chromosome11 | | 74 | 98.0275 | FYIDKCIHF | 9 | 23.2 | 1000000.0 | 1000000.0 | 0.120 |
| 571.t00003 | Chromosome11 | | 162 | 98.0276 | FYTNYYQSF | 9 | 48.3 | 1000000.0 | 1000000.0 | 0.186 |
| 571.t00003 | Chromosome11 | | 177 | 98.0277 | PYINQTNIF | 9 | 228.9 | 1000000.0 | 1000000.0 | 0.527 |
| 571.t00003 | Chromosome11 | | 807 | 98.0278 | NYPNNANHI | 9 | 176667.0 | 1000000.0 | 1000000.0 | 3.103 |
| 571.t00003 | Chromosome11 | | 834 | 98.0279 | TYNNFHNSY | 9 | 52.4 | 1000000.0 | 1000000.0 | 0.776 |
| 571.t00003 | Chromosome11 | | 1917 | 98.0280 | YMNNNTYSF | 9 | 7.7 | 1000000.0 | 1000000.0 | 2.132 |
| 571.t00003 | Chromosome11 | | 2026 | 98.0281 | KYTEGATNF | 9 | 74.8 | 1000000.0 | 1000000.0 | 1.964 |
| 571.t00003 | Chromosome11 | | 2450 | 98.0282 | FYISIIDII | 9 | 150563.0 | 1000000.0 | 1000000.0 | 1.632 |
| 571.t00003 | Chromosome11 | | 2540 | 98.0283 | YYKEHISEF | 9 | 96.3 | 1000000.0 | 1000000.0 | 3.143 |
| 571.t00003 | Chromosome11 | | 2914 | 98.0284 | YYNRANNEI | 9 | 46291.4 | 1000000.0 | 1000000.0 | 3.342 |
| MP03072 | PFC0450w | CAA15614 | 17 | 98.0285 | AFLLITFLM | 9 | 37258.4 | 1000000.0 | 1000000.0 | 17.525 |
| MP03072 | PFC0450w | CAA15614 | 53 | 98.0195 | LYVIFLVLLF | 10 | 174.0 | 1000000.0 | 1000000.0 | 16.581 |
| MP03072 | PFC0450w | CAA15614 | 53 | 98.0286 | LYVIFLVLL | 9 | 107336.6 | 1000000.0 | 1000000.0 | 5.089 |
| MP03072 | PFC0450w | CAA15614 | 86 | 98.0287 | KYVQLASTY | 9 | 65.1 | 1000000.0 | 1000000.0 | 70.547 |
| 45.t00001 | Chromosome14 | | 21 | 98.0196 | RYQDPQNYEL | 10 | 1000000.0 | 1000000.0 | 1000000.0 | 46.471 |
| 45.t00001 | Chromosome14 | | 40 | 98.0288 | IYYFDGNSW | 9 | 97026.0 | 1000000.0 | 1000000.0 | 15.493 |
| 45.t00001 | Chromosome14 | | 94 | 98.0289 | VYRHCEYIL | 9 | 560574.8 | 1000000.0 | 1000000.0 | 27.538 |
| 45.t00001 | Chromosome14 | | 135 | 98.0290 | TWKPTIFLL | 9 | 34068.5 | 1000000.0 | 1000000.0 | 26.741 |
| 45.t00001 | Chromosome14 | | 168 | 98.0291 | SYKVNCINF | 9 | 25.3 | 1000000.0 | 1000000.0 | 63.592 |
| 45.t00001 | Chromosome14 | | 216 | 98.0292 | KYNYFIHFF | 9 | 39.1 | 1000000.0 | 1000000.0 | 0.380 |
| 45.t00001 | Chromosome14 | | 218 | 98.0293 | NYFIHFFTW | 9 | 95820.5 | 1000000.0 | 1000000.0 | 2.156 |
| 45.t00001 | Chromosome14 | | 222 | 98.0294 | HFFTWGTMF | 9 | 17.4 | 1000000.0 | 1000000.0 | 6.418 |
| 45.t00001 | Chromosome14 | | 229 | 98.0295 | MFVPKYFEL | 9 | 57423.3 | 1000000.0 | 1000000.0 | 28.589 |
| 45.t00001 | Chromosome14 | | 295 | 98.0296 | IYTIIQDQL | 9 | 334935.0 | 1000000.0 | 1000000.0 | 9.774 |
| MP03137 | PFC0700c | CAB11150 | 3 | 98.0197 | DFFLKSKFNI | 10 | 1000000.0 | 1000000.0 | 1000000.0 | 79.527 |
| MP03137 | PFC0700c | CAB11150 | 4 | 98.0297 | FFLKSKFNI | 9 | 80470.7 | 1000000.0 | 1000000.0 | 10.043 |
| MP03137 | PFC0700c | CAB11150 | 9 | 98.0298 | KFNILSSPL | 9 | 275819.0 | 1000000.0 | 1000000.0 | 48.661 |
| MP03137 | PFC0700c | CAB11150 | 61 | 98.0299 | RMTSLKNEL | 9 | 45471.5 | 1089.6 | 1000000.0 | 50.292 |
| MP03137 | PFC0700c | CAB11150 | 77 | 98.0300 | YYNNFNNNY | 9 | 29.9 | 1000000.0 | 1000000.0 | 2.802 |
| MP03137 | PFC0700c | CAB11150 | 87 | 98.0301 | YYNKSTEKL | 9 | 25069.1 | 1000000.0 | 1000000.0 | 6.131 |
| MP03137 | PFC0700c | CAB11150 | 109 | 98.0302 | EYEPTANLL | 9 | 29899.8 | 1000000.0 | 1000000.0 | 9.359 |
| 12.t00018 | Chromosome14 | | 479 | 98.0303 | PYEEVENYF | 9 | 118.2 | 1000000.0 | 1000000.0 | 3.525 |
| 12.t00018 | Chromosome14 | | 506 | 98.0304 | KFILHMTLL | 9 | 418744.3 | 1000000.0 | 1000000.0 | 7.942 |
| 12.t00018 | Chromosome14 | | 544 | 98.0305 | NFLNIYASL | 9 | 309896.9 | 1000000.0 | 1000000.0 | 7.653 |
| 12.t00018 | Chromosome14 | | 594 | 98.0306 | VWKKLIEYF | 9 | 120.2 | 1000000.0 | 1000000.0 | 7.058 |
| 12.t00018 | Chromosome14 | | 614 | 98.0307 | LYVSMYIPF | 9 | 113.5 | 1000000.0 | 1000000.0 | 6.679 |
| 12.t00018 | Chromosome14 | | 618 | 98.0308 | MYIPFIKKF | 9 | 62.3 | 1000000.0 | 1000000.0 | 2.663 |
| 12.t00018 | Chromosome14 | | 625 | 98.0309 | KFYDKRFIF | 9 | 53.3 | 1000000.0 | 1000000.0 | 1.395 |
| 12.t00018 | Chromosome14 | | 675 | 98.0310 | IYNMYHNNF | 9 | 27.2 | 1000000.0 | 1000000.0 | 0.737 |
| 12.t00018 | Chromosome14 | | 678 | 98.0311 | MYHNNFSYF | 9 | 61.8 | 1000000.0 | 1000000.0 | 5.105 |
| 12.t00018 | Chromosome14 | | 815 | 98.0312 | KYDITKNLI | 9 | 86746.4 | 1000000.0 | 1000000.0 | 2.983 |
| mal_BU121g9.q1c1 | | | 61 | 98.0313 | GYFKRIFKL | 9 | 39278.5 | 1000000.0 | 1000000.0 | 64.889 |
| mal_BU121g9.q1c1 | | | 81 | 98.0314 | TYKNGNIYI | 9 | 240142.1 | 1000000.0 | 1000000.0 | 20.110 |
| mal_BU121g9.q1c1 | | | 87 | 98.0315 | IYIYIYIYI | 9 | 133656.3 | 1000000.0 | 1000000.0 | 2.246 |
| mal_BU121g9.q1c1 | | | 89 | 98.0198 | IYIYIYIYFL | 10 | 1000000.0 | 1000000.0 | 1000000.0 | 72.026 |
| mal_BU121g9.q1c1 | | | 89 | 98.0316 | IYIYIYIYF | 9 | 89.8 | 1000000.0 | 1000000.0 | 0.543 |
| mal_9A57b11.q1t2 | | | 75 | 98.0317 | IFKNDNNTF | 9 | 290.7 | 1000000.0 | 1000000.0 | 11.568 |
| mal_9A57b11.q1t2 | | | 103 | 98.0318 | KYGNICHHI | 9 | 61693.1 | 1000000.0 | 1000000.0 | 4.552 |
| mal_9A57b11.q1t2 | | | 139 | 98.0319 | QYTDIPSLI | 9 | 41835.9 | 1000000.0 | 1000000.0 | 24.727 |
| mal_9A57b11.q1t2 | | | 159 | 98.0320 | VFCYEYFIF | 9 | 98.9 | 1000000.0 | 1000000.0 | 69.226 |
| mal_9A57b11.q1t2 | | | 161 | 98.0199 | CYEYFIFDIF | 10 | 811.1 | 1000000.0 | 1000000.0 | 61.974 |
| mal_9A57b11.q1t2 | | | 161 | 98.0321 | CYEYFIFDI | 9 | 32300.1 | 1000000.0 | 1000000.0 | 79.659 |
| mal_9A57b11.q1t2 | | | 171 | 98.0322 | KYARNILSL | 9 | 27927.9 | 1000000.0 | 1000000.0 | 3.398 |
| mal_9A57b11.q1t2 | | | 230 | 98.0323 | IFVKYLPLF | 9 | 68.2 | 1000000.0 | 1000000.0 | 30.518 |
| mal_9A57b11.q1t2 | | | 233 | 98.0324 | KYLPLFLMM | 9 | 16925.5 | 1000000.0 | 1000000.0 | 15.776 |
| mal_9A57b11.q1t2 | | | 237 | 98.0325 | LFLMMEHSF | 9 | 51.0 | 1000000.0 | 1000000.0 | 70.804 |
| mal_BL50e8.p1ca_5 | | | 116 | 98.0326 | QYSNYFDYL | 9 | 103941.7 | 1000000.0 | 1000000.0 | 17.499 |
| mal_BL50e8.p1ca_5 | | | 184 | 98.0327 | PYETNNNLF | 9 | 37.2 | 1000000.0 | 1000000.0 | 4.367 |
| mal_BL50e8.p1ca_5 | | | 341 | 98.0328 | YYSRRVEKI | 9 | 33168.4 | 1000000.0 | 1000000.0 | 6.349 |
| mal_BL50e8.p1ca_5 | | | 555 | 98.0329 | KFKWIQDNL | 9 | 453346.6 | 1000000.0 | 1000000.0 | 30.007 |
| mal_BL50e8.p1ca_5 | | | 687 | 98.0200 | RYVGLGSFHF | 10 | 1143.3 | 1000000.0 | 1000000.0 | 33.267 |
| mal_BL50e8.p1ca_5 | | | 768 | 98.0330 | TYKMYPPEF | 9 | 68.2 | 1000000.0 | 1000000.0 | 7.746 |
| mal_BL50e8.p1ca_5 | | | 771 | 98.0331 | MYPPEFNTL | 9 | 37286.8 | 1000000.0 | 1000000.0 | 14.291 |
| mal_BL50e8.p1ca_5 | | | 827 | 98.0332 | KYCIGSTYF | 9 | 184.3 | 1000000.0 | 1000000.0 | 0.261 |
| mal_BL50e8.p1ca_5 | | | 833 | 98.0333 | TYFLRQVSI | 9 | 163553.3 | 1000000.0 | 1000000.0 | 31.623 |
| mal_BL50e8.p1ca_5 | | | 857 | 98.0334 | KYSARLHPI | 9 | 52609.1 | 1000000.0 | 1000000.0 | 33.171 |
| M13S8h6.p1t_3 | | | 152 | 98.0335 | FYLKKKFLF | 9 | 30.5 | 1000000.0 | 1000000.0 | 0.091 |
| M13S8h6.p1t_3 | | | 298 | 98.0336 | KYYISYKVL | 9 | 328554.4 | 1000000.0 | 1000000.0 | 3.468 |
| M13S8h6.p1t_3 | | | 321 | 98.0337 | KYINKNISL | 9 | 213679.4 | 1000000.0 | 1000000.0 | 0.395 |
| M13S8h6.p1t_3 | | | 380 | 98.0338 | KYLKEDNTF | 9 | 189.5 | 1000000.0 | 1000000.0 | 2.580 |
| M13S8h6.p1t_3 | | | 753 | 98.0339 | KYGDNENNF | 9 | 50.4 | 1000000.0 | 1000000.0 | 2.048 |
| M13S8h6.p1t_3 | | | 1208 | 98.0340 | VFTKINNLF | 9 | 55.7 | 1000000.0 | 1000000.0 | 4.101 |

TABLE 3-continued

Pf-derived A24 supertype peptides with PIG <100 nM

| | | | | | | | PIC | | | |
|---|---|---|---|---|---|---|---|---|---|---|
| Malaria locus | Addn Source info | Accession No. | Position | Peptide No. | Sequence | AA | A*0101 PIC | A*0201 | A*1101 | A*2402 PIC |
| M13S8h6.p1t_3 | | | 1438 | 98.0341 | IWLIRSIYL | 9 | 175087.7 | 1000000.0 | 1000000.0 | 2.659 |
| M13S8h6.p1t_3 | | | 1444 | 98.0342 | IYLFIITYI | 9 | 153399.4 | 1000000.0 | 1000000.0 | 4.385 |
| M13S8h6.p1t_3 | | | 1536 | 98.0343 | FFFVFFYIF | 9 | 26.2 | 1000000.0 | 1000000.0 | 0.631 |
| M13S8h6.p1t_3 | | | 1541 | 98.0344 | FYIFLIYSF | 9 | 60.5 | 1000000.0 | 1000000.0 | 0.315 |
| 585.t00002 | Chromosome11 | | 1 | 98.0345 | MYIFFFILF | 9 | 12.6 | 1000000.0 | 1000000.0 | 1.911 |
| 585.t00002 | Chromosome11 | | 11 | 98.0346 | FYVMSTYTF | 9 | 45.7 | 1000000.0 | 1000000.0 | 0.144 |
| 585.t00002 | Chromosome11 | | 512 | 98.0347 | RYCTKCFLW | 9 | 31357.1 | 1000000.0 | 1000000.0 | 1.726 |
| 585.t00002 | Chromosome11 | | 605 | 98.0348 | VYAKNIPLW | 9 | 36459.4 | 1000000.0 | 1000000.0 | 1.882 |
| 585.t00002 | Chromosome11 | | 663 | 98.0349 | FFCIFFISL | 9 | 35177.1 | 1000000.0 | 1000000.0 | 1.436 |
| 585.t00002 | Chromosome11 | | 681 | 98.0350 | PYYKKKNLF | 9 | 53.3 | 1000000.0 | 1000000.0 | 2.732 |
| 585.t00002 | Chromosome11 | | 1378 | 98.0351 | FYTLVNILI | 9 | 40959.2 | 1000000.0 | 1000000.0 | 2.113 |
| 585.t00002 | Chromosome11 | | 1419 | 98.0352 | YFIIRSYEL | 9 | 135598.6 | 1000000.0 | 1000000.0 | 2.721 |
| 585.t00002 | Chromosome11 | | 1483 | 98.0353 | KYICLTCAF | 9 | 30.1 | 1000000.0 | 1000000.0 | 0.435 |
| 585.t00002 | Chromosome11 | | 1752 | 98.0354 | KYDLFNNFI | 9 | 83062.5 | 1000000.0 | 1000000.0 | 1.355 |
| 1223.t00015 | mal_9A21f9.q1t_4 | | 1202 | 98.0355 | KYKDMAKIF | 9 | 215.2 | 1000000.0 | 1000000.0 | 0.315 |
| 1223.t00015 | mal_9A21f9.q1t_4 | | 1599 | 98.0356 | GYRPFIYSW | 9 | 83421.5 | 1000000.0 | 1000000.0 | 3.292 |
| 1223.t00015 | mal_9A21f9.q1t_4 | | 1621 | 98.0357 | LYAIFNKLF | 9 | 57.9 | 1000000.0 | 1000000.0 | 0.212 |
| 1223.t00015 | mal_9A21f9.q1t_4 | | 1631 | 98.0358 | FYLDKIQIL | 9 | 36632.3 | 1000000.0 | 1000000.0 | 0.942 |
| 1223.t00015 | mal_9A21f9.q1t_4 | | 2272 | 98.0359 | RMEDKTFSL | 9 | 8870.6 | 143.4 | 1000000.0 | 4.349 |
| 1223.t00015 | mal_9A21f9.q1t_4 | | 2702 | 98.0360 | IYNCVTINW | 9 | 10684.6 | 1000000.0 | 1000000.0 | 2.727 |
| 1223.t00015 | mal_9A21f9.q1t_4 | | 3109 | 98.0361 | RWTDDSNNF | 9 | 60.4 | 1000000.0 | 1000000.0 | 1.600 |
| 1223.t00015 | mal_9A21f9.q1t_4 | | 3735 | 98.0362 | FFYDILNVI | 9 | 40209.1 | 1000000.0 | 1000000.0 | 5.095 |
| 1223.t00015 | mal_9A21f9.q1t_4 | | 3968 | 98.0363 | KYRKIIYSL | 9 | 215862.1 | 1000000.0 | 1000000.0 | 0.665 |
| 1223.t00015 | mal_9A21f9.q1t_4 | | 4515 | 98.0364 | KYFIFRIHL | 9 | 114989.5 | 1000000.0 | 1000000.0 | 0.325 |
| 599.t00001 | Chromosome11 | | 8 | 98.0365 | KYLTINFFI | 9 | 160943.0 | 1000000.0 | 1000000.0 | 0.123 |
| 599.t00001 | Chromosome11 | | 14 | 98.0366 | FFILLTLVF | 9 | 30.5 | 1000000.0 | 1000000.0 | 3.495 |
| 599.t00001 | Chromosome11 | | 24 | 98.0367 | KYSSCQNSL | 9 | 213208.8 | 1000000.0 | 1000000.0 | 0.906 |
| 599.t00001 | Chromosome11 | | 955 | 98.0368 | KFIEHINEF | 9 | 278.8 | 1000000.0 | 1000000.0 | 1.175 |
| 599.t00001 | Chromosome11 | | 1118 | 98.0369 | KYIELNDLI | 9 | 231736.0 | 1000000.0 | 1000000.0 | 1.464 |
| 599.t00001 | Chromosome11 | | 1194 | 98.0370 | PYSNVTYVI | 9 | 97127.6 | 1000000.0 | 1000000.0 | 1.861 |
| 599.t00001 | Chromosome11 | | 1434 | 98.0371 | MYDILNAYF | 9 | 42.0 | 1000000.0 | 1000000.0 | 1.204 |
| 599.t00001 | Chromosome11 | | 1769 | 98.0372 | HYIMNNTIF | 9 | 38.3 | 1000000.0 | 1000000.0 | 1.389 |
| 599.t00001 | Chromosome11 | | 1929 | 98.0373 | FFKYIISYF | 9 | 126.1 | 1000000.0 | 1000000.0 | 3.000 |
| 599.t00001 | Chromosome11 | | 1943 | 98.0374 | KYLNDDNYL | 9 | 679247.8 | 1000000.0 | 1000000.0 | 0.368 |
| MP01072 | M1045c5.p1c.C_6 | | 67 | 98.0375 | LYKSIFKAF | 9 | 52.5 | 1000000.0 | 1000000.0 | 21.749 |
| MP01072 | M1045c5.p1c.C_6 | | 107 | 98.0376 | SYRIVNAGF | 9 | 268.7 | 1000000.0 | 1000000.0 | 7.480 |
| MP01072 | M1045c5.p1c.C_6 | | 319 | 98.0377 | KYTFRSLSI | 9 | 63496.4 | 1000000.0 | 1000000.0 | 7.958 |
| MP01072 | M1045c5.p1c.C_6 | | 388 | 98.0378 | KYKNDSNRI | 9 | 401700.0 | 1000000.0 | 1000000.0 | 6.170 |
| MP01072 | M1045c5.p1c.C_6 | | 612 | 98.0379 | SYIYNKNIF | 9 | 105.6 | 1000000.0 | 1000000.0 | 13.043 |
| MP01072 | M1045c5.p1c.C_6 | | 1042 | 98.0380 | FMKNNTTLF | 9 | 11.7 | 1000000.0 | 1000000.0 | 2.141 |
| MP01072 | M1045c5.p1c.C_6 | | 1123 | 98.0381 | HYVMINNNL | 9 | 52910.4 | 1000000.0 | 1000000.0 | 3.607 |
| MP01072 | M1045c5.p1c.C_6 | | 1163 | 98.0382 | FFLFFSIFI | 9 | 69264.3 | 1000000.0 | 1000000.0 | 2.646 |
| MP01072 | M1045c5.p1c.C_6 | | 1249 | 98.0383 | RYFLHTITI | 9 | 101443.4 | 1000000.0 | 1000000.0 | 2.834 |
| MP01072 | M1045c5.p1c.C_6 | | 1260 | 98.0384 | KYTSSYDSL | 9 | 230897.9 | 1000000.0 | 1000000.0 | 1.533 |
| PIR2 | T28161 | | 243 | 98.0385 | YYKLREDWW | 9 | 283854.6 | 1000000.0 | 1000000.0 | 8.617 |
| PIR2 | T28161 | | 304 | 98.0386 | QYLRWFEEW | 9 | 35188.7 | 1000000.0 | 1000000.0 | 14.859 |
| PIR2 | T28161 | | 628 | 98.0387 | HWTQIKKHF | 9 | 30.8 | 1000000.0 | 1000000.0 | 11.497 |
| PIR2 | T28161 | | 647 | 98.0388 | HYFVLETVL | 9 | 65432.8 | 1000000.0 | 1000000.0 | 12.976 |
| PIR2 | T28161 | | 833 | 98.0389 | RWMDTAGFI | 9 | 32693.4 | 1000000.0 | 1000000.0 | 6.822 |
| PIR2 | T28161 | | 848 | 98.0201 | IYMPPRRQHF | 10 | 391.2 | 1000000.0 | 1000000.0 | 14.666 |
| PIR2 | T28161 | | 1024 | 98.0390 | RWMTEWAEW | 9 | 39609.0 | 1000000.0 | 1000000.0 | 3.877 |
| PIR2 | T28161 | | 1574 | 98.0391 | KYQYDKVKL | 9 | 515925.0 | 1000000.0 | 1000000.0 | 6.877 |
| PIR2 | T28161 | | 1681 | 98.0392 | KYCRFYKRW | 9 | 239673.9 | 1000000.0 | 1000000.0 | 3.433 |
| PIR2 | T28161 | | 1887 | 98.0393 | YFLDDYNKI | 9 | 114991.6 | 1000000.0 | 1000000.0 | 7.588 |
| 55.t00004 | Chromosome14 | | 223 | 98.0394 | KYELRKTSI | 9 | 226076.9 | 1000000.0 | 1000000.0 | 3.213 |
| 55.t00004 | Chromosome14 | | 339 | 98.0395 | MYKNKVDPL | 9 | 208222.7 | 1000000.0 | 1000000.0 | 31.490 |
| 55.t00004 | Chromosome14 | | 455 | 98.0396 | YYDTCKNIW | 9 | 80910.8 | 1000000.0 | 1000000.0 | 11.820 |
| 55.t00004 | Chromosome14 | | 686 | 98.0397 | KYINNMSFI | 9 | 317672.0 | 1000000.0 | 1000000.0 | 1.757 |
| 55.t00004 | Chromosome14 | | 896 | 98.0398 | LYPWKENKF | 9 | 99.5 | 1000000.0 | 1000000.0 | 6.128 |
| 55.t00004 | Chromosome14 | | 973 | 98.0399 | KWNVFNNSI | 9 | 191824.0 | 1000000.0 | 1000000.0 | 0.536 |
| 55.t00004 | Chromosome14 | | 1027 | 98.0400 | KFKIINSYI | 9 | 648818.6 | 1000000.0 | 1000000.0 | 2.246 |
| 55.t00004 | Chromosome14 | | 1123 | 98.0401 | NYAYDNIEL | 9 | 113781.7 | 1000000.0 | 1000000.0 | 8.937 |
| 55.t00004 | Chromosome14 | | 1155 | 98.0402 | IYTSTNNII | 9 | 105468.3 | 1000000.0 | 1000000.0 | 7.723 |
| 55.t00004 | Chromosome14 | | 1268 | 98.0403 | KYTYNINNL | 9 | 65476.9 | 1000000.0 | 1000000.0 | 7.681 |
| 13.t00011 | Chromosome14 | | 68 | 98.0202 | RYNVINHIYL | 10 | 1000000.0 | 1000000.0 | 1000000.0 | 74.419 |
| 13.t00011 | Chromosome14 | | 68 | 98.0404 | RYNVINHIY | 9 | 26.0 | 1000000.0 | 1000000.0 | 55.779 |
| 13.t00011 | Chromosome14 | | 84 | 98.0405 | TYNYLTPTL | 9 | 75416.9 | 1000000.0 | 1000000.0 | 7.874 |
| 13.t00011 | Chromosome14 | | 96 | 98.0203 | RFRVFKDYSF | 10 | 3387.1 | 1000000.0 | 1000000.0 | 29.344 |
| 13.t00011 | Chromosome14 | | 99 | 98.0406 | VFKDYSFFI | 9 | 99598.3 | 1000000.0 | 1000000.0 | 7.373 |
| 13.t00011 | Chromosome14 | | 105 | 98.0407 | FFIDEVKKI | 9 | 230004.2 | 1000000.0 | 1000000.0 | 12.686 |
| 37.t00002 | Chromosome14 | | 20 | 98.0408 | VYYDNYESL | 9 | 72350.5 | 1000000.0 | 1000000.0 | 10.652 |
| 674.t00001 | Chromosome11 | | 68 | 98.0409 | RFVEKIYYL | 9 | 228887.0 | 1000000.0 | 1000000.0 | 8.045 |
| 674.t00001 | Chromosome11 | | 114 | 98.0410 | IYINVQKNL | 9 | 306183.0 | 1000000.0 | 1000000.0 | 14.033 |

TABLE 3-continued

Pf-derived A24 supertype peptides with PIG <100 nM

| Malaria locus | Addn Source info | Accession No. | Position | Peptide No. | Sequence | AA | A*0101 PIC | A*0201 PIC | A*1101 PIC | A*2402 PIC |
|---|---|---|---|---|---|---|---|---|---|---|
| 674.t00001 | Chromosome11 | | 140 | 98.0411 | KFYYYFKEF | 9 | 92.8 | 1000000.0 | 1000000.0 | 14.487 |
| 674.t00001 | Chromosome11 | | 141 | 98.0204 | FYYYFKEFLL | 10 | 1000000.0 | 1000000.0 | 1000000.0 | 13.628 |
| 674.t00001 | Chromosome11 | | 141 | 98.0412 | FYYYFKEFL | 9 | 104311.6 | 1000000.0 | 1000000.0 | 1.300 |
| 674.t00001 | Chromosome11 | | 418 | 98.0413 | TYIPDKKLL | 9 | 209801.1 | 1000000.0 | 1000000.0 | 17.181 |
| 674.t00001 | Chromosome11 | | 461 | 98.0414 | NYLYNKYYI | 9 | 288938.1 | 1000000.0 | 1000000.0 | 5.750 |
| 674.t00001 | Chromosome11 | | 579 | 98.0415 | NFKEQHLLF | 9 | 72.4 | 1000000.0 | 1000000.0 | 38.780 |
| 674.t00001 | Chromosome11 | | 649 | 98.0416 | HYINNKHNL | 9 | 41447.1 | 1000000.0 | 1000000.0 | 10.887 |
| 674.t00001 | Chromosome11 | | 800 | 98.0417 | LYREHSREL | 9 | 274526.6 | 1000000.0 | 1000000.0 | 38.601 |
| 674.t00001 | Chromosome11 | | 1095 | 98.0418 | NYINNNIYL | 9 | 268777.1 | 1000000.0 | 1000000.0 | 3.259 |
| 674.t00001 | Chromosome11 | | 1117 | 98.0419 | NYNQKENSF | 9 | 40.2 | 1000000.0 | 1000000.0 | 27.868 |
| 674.t00001 | Chromosome11 | | 1396 | 98.0205 | QYKVKIKPVF | 10 | 5076.8 | 1000000.0 | 1000000.0 | 42.788 |

TABLE 4

Pf-derived A2 supertype peptides with PIC <100 nM

| Malaria locus | Addn Source info | Position | Accession No. | Peptide No. | Sequence | AA | A*0101 | A*0201 PIC | A*1101 | A*2402 |
|---|---|---|---|---|---|---|---|---|---|---|
| 331.t00003 | Chromosome10 | 105 | | 99.0042 | LIYPCVYEI | 9 | 38050.5 | 43.8 | 1000000.0 | 1000000.0 |
| 331.t00003 | Chromosome10 | 598 | | 99.0043 | NMNVQNFFV | 9 | 50979.5 | 35.3 | 1000000.0 | 1000000.0 |
| 331.t00003 | Chromosome10 | 605 | | 99.0044 | FVWGHDMFM | 9 | 25516.6 | 18.5 | 1000000.0 | 1000000.0 |
| 331.t00003 | Chromosome10 | 660 | | 99.0045 | QLDDKFAFI | 9 | 3138.5 | 43.0 | 1000000.0 | 1000000.0 |
| 331.t00003 | Chromosome10 | 950 | | 99.0046 | CLINHNFFM | 9 | 63467.3 | 65.7 | 1000000.0 | 1000000.0 |
| 331.t00003 | Chromosome10 | 957 | | 99.0047 | FMLVGGINI | 9 | 11445.4 | 72.5 | 1000000.0 | 399.0 |
| 331.t00003 | Chromosome10 | 1007 | | 99.0048 | YIIGGGCTV | 9 | 19833.9 | 77.9 | 1000000.0 | 1000000.0 |
| 331.t00003 | Chromosome10 | 1016 | | 99.0049 | FTFGSFFDV | 9 | 2705.2 | 14.1 | 1000000.0 | 1000000.0 |
| 331.t00003 | Chromosome10 | 1847 | | 99.0050 | NLSFAQYTL | 9 | 22775.6 | 52.7 | 1000000.0 | 1000000.0 |
| 331.t00003 | Chromosome10 | 1889 | | 99.0051 | RMYHYVVDI | 9 | 47589.4 | 49.4 | 1000000.0 | 890.2 |
| 18.000811 | Chr12Contig18 | 2 | | 99.0001 | VLRLFVCFLI | 10 | 1000000.0 | 72.4 | 1000000.0 | 1000000.0 |
| 18.000811 | Chr12Contig18 | 9 | | 99.0002 | FLIFHFFLFL | 10 | 1000000.0 | 10.9 | 1000000.0 | 1000000.0 |
| 18.000811 | Chr12Contig18 | 10 | | 99.0003 | LIFHFFLFLL | 10 | 1000000.0 | 29.1 | 1000000.0 | 1000000.0 |
| 18.000811 | Chr12Contig18 | 15 | | 99.0004 | FLFLLYILFL | 10 | 404264.4 | 19.6 | 1000000.0 | 1000000.0 |
| 18.000811 | Chr12Contig18 | 32 | | 99.0005 | RLPVICSFLV | 10 | 1000000.0 | 99.3 | 1000000.0 | 1000000.0 |
| 18.000811 | Chr12Contig18 | 35 | | 99.0006 | VICSFLVFLV | 10 | 1000000.0 | 71.5 | 1000000.0 | 1000000.0 |
| 18.000811 | Chr12Contig18 | 39 | | 99.0007 | FLVFLVFSNV | 10 | 1000000.0 | 45.6 | 1000000.0 | 1000000.0 |
| 18.000811 | Chr12Contig18 | 10 | | 99.0052 | LIFHFFLFL | 9 | 8592.7 | 9.8 | 1000000.0 | 1000000.0 |
| 18.000811 | Chr12Contig18 | 17 | | 99.0053 | FLLYILFLV | 9 | 6742.1 | 1.9 | 1000000.0 | 1000000.0 |
| 18.000811 | Chr12Contig18 | 35 | | 99.0054 | VICSFLVFL | 9 | 43080.6 | 76.0 | 1000000.0 | 1000000.0 |
| 18.000811 | Chr12Contig18 | 159 | | 99.0055 | ATYGIIVPV | 9 | 18077.0 | 45.4 | 1000000.0 | 1000000.0 |
| MY924Fe3.p1t1 | | 222 | | 99.0008 | FLYAFNKYYV | 10 | 538964.2 | 15.2 | 1000000.0 | 1000000.0 |
| MY924Fe3.p1t1 | | 127 | | 99.0056 | NMISVVYYI | 9 | 97099.2 | 14.5 | 1000000.0 | 8.2 |
| MY924Fe3.p1t1 | | 299 | | 99.0057 | SLCFYFLLL | 9 | 2719.7 | 20.9 | 1000000.0 | 1000000.0 |
| MY924Fe3.p1t1 | | 470 | | 99.0058 | ILFLHNYLL | 9 | 31359.3 | 26.7 | 1000000.0 | 1000000.0 |
| MY924Fe3.p1t1 | | 512 | | 99.0059 | YLDVYNFLL | 9 | 4353.0 | 7.2 | 1000000.0 | 1000000.0 |
| MY924Fe3.p1t1 | | 1209 | | 99.0060 | FQLYYMYYL | 9 | 91212.8 | 4.0 | 1000000.0 | 1000000.0 |
| MY924Fe3.p1t1 | | 1267 | | 99.0061 | YVMDKVLRL | 9 | 984.8 | 45.3 | 1000000.0 | 1000000.0 |
| MY924Fe3.p1t1 | | 2260 | | 99.0062 | LLFILSHFI | 9 | 11073.4 | 23.7 | 1000000.0 | 1000000.0 |
| MY924Fe3.p1t1 | | 2326 | | 99.0063 | YLVNYCLVV | 9 | 16842.3 | 10.9 | 1000000.0 | 1000000.0 |
| MY924Fe3.p1t1 | | 2395 | | 99.0064 | KIYVCIYYL | 9 | 157982.7 | 39.3 | 1000000.0 | 1000000.0 |
| MP03001 | MAL3P2.11 | 6 | CAB38998 | 99.0009 | ILSVSSFLFV | 10 | 1000000.0 | 94.9 | 1000000.0 | 1000000.0 |
| MP03001 | MAL3P2.11 | 386 | CAB38998 | 99.0010 | LIMVLSFLFL | 10 | 1000000.0 | 38.4 | 1000000.0 | 1000000.0 |
| MP03001 | MAL3P2.11 | 318 | CAB38998 | 99.0065 | YLNKIQNSL | 9 | 13496.2 | 78.4 | 1000000.0 | 1000000.0 |
| MP03001 | MAL3P2.11 | 387 | CAB38998 | 99.0066 | IMVLSFLFL | 9 | 8739.3 | 36.0 | 1000000.0 | 2608.6 |
| 1369.t00001 | Chromosome 11 | 60 | | 99.0011 | VQMMIMIKFM | 10 | 1000000.0 | 96.6 | 1000000.0 | 1000000.0 |
| 1369.t00001 | Chromosome 11 | 62 | | 99.0012 | MMIMIKFMGV | 10 | 1000000.0 | 47.1 | 1000000.0 | 1000000.0 |
| 1369.t00001 | Chromosome 11 | 9 | | 99.0067 | KIYKIIIWI | 9 | 56576.0 | 72.2 | 1000000.0 | 1000000.0 |
| 1369.t00001 | Chromosome 11 | 23 | | 99.0068 | YMIKKLLKI | 9 | 4324.7 | 52.7 | 1000000.0 | 788.9 |
| 1369.t00001 | Chromosome 11 | 42 | | 99.0069 | LMTLYQIQV | 9 | 32880.1 | 41.7 | 1000000.0 | 1000000.0 |
| 1369.t00001 | Chromosome 11 | 68 | | 99.0070 | FMGVIYIMI | 9 | 10136.0 | 91.9 | 1000000.0 | 58.6 |
| 1369.t00001 | Chromosome 11 | 280 | | 99.0071 | NILIVLYYL | 9 | 117610.0 | 42.8 | 1000000.0 | 1000000.0 |
| 1369.t00001 | Chromosome 11 | 312 | | 99.0072 | FMNRFYITT | 9 | 14073.8 | 47.8 | 1000000.0 | 1000000.0 |
| 699.t00001 | Chromosome 11 | 488 | | 99.0013 | YLYISFLLLI | 10 | 311433.0 | 34.2 | 1000000.0 | 1000000.0 |
| 699.t00001 | Chromosome 11 | 1025 | | 99.0014 | YIYIFIYLFI | 10 | 1000000.0 | 19.8 | 1000000.0 | 1000000.0 |
| 699.t00001 | Chromosome 11 | 408 | | 99.0073 | LLDDYHFET | 9 | 5923.7 | 39.5 | 1000000.0 | 1000000.0 |
| 699.t00001 | Chromosome 11 | 488 | | 99.0074 | YLYISFLLL | 9 | 2547.9 | 11.2 | 1000000.0 | 1000000.0 |
| 699.t00001 | Chromosome 11 | 572 | | 99.0075 | FLTLTVYPI | 9 | 22535.9 | 28.3 | 1000000.0 | 1000000.0 |
| 699.t00001 | Chromosome 11 | 651 | | 99.0076 | FIIEILELL | 9 | 15575.2 | 47.0 | 1000000.0 | 1000000.0 |

TABLE 4-continued

Pf-derived A2 supertype peptides with PIC <100 nM

| Malaria locus | Addn Source info | Position | Accession No. | Peptide No. | Sequence | AA | A*0101 | PIC A*0201 | A*1101 | A*2402 |
|---|---|---|---|---|---|---|---|---|---|---|
| 699.t00001 | Chromosome 11 | 782 | | 99.0077 | LLYNHITSI | 9 | 62668.0 | 50.4 | 1000000.0 | 1000000.0 |
| 699.t00001 | Chromosome 11 | 882 | | 99.0078 | YMNFLKFIV | 9 | 14215.9 | 50.3 | 1000000.0 | 1000000.0 |
| 699.t00001 | Chromosome 11 | 1033 | | 99.0079 | FIYIWLHLI | 9 | 6243.9 | 15.6 | 1000000.0 | 1000000.0 |
| 699.t00001 | Chromosome 11 | 1039 | | 99.0080 | HLIIIFIFV | 9 | 6908.2 | 11.5 | 1000000.0 | 1000000.0 |
| M13Hg2.q1t3 | | 576 | | 99.0015 | FLMWSSQIII | 10 | 96042.7 | 91.8 | 1000000.0 | 1000000.0 |
| M13Hg2.q1t3 | | 96 | | 99.0081 | ILLSRFIFI | 9 | 11278.3 | 22.9 | 1000000.0 | 1000000.0 |
| M13Hg2.q1t3 | | 508 | | 99.0082 | YLNFQDNYL | 9 | 34942.8 | 80.6 | 1000000.0 | 1000000.0 |
| M13Hg2.q1t3 | | 551 | | 99.0083 | NIPYFNFFV | 9 | 86593.7 | 41.8 | 1000000.0 | 1000000.0 |
| M13Hg2.q1t3 | | 558 | | 99.0084 | FVNYFEAVV | 9 | 15474.4 | 100.0 | 1000000.0 | 1000000.0 |
| M13Hg2.q1t3 | | 569 | | 99.0085 | NIHCYTYFL | 9 | 27934.2 | 25.6 | 1000000.0 | 1000000.0 |
| M13Hg2.q1t3 | | 576 | | 99.0086 | FLMWSSQII | 9 | 5275.5 | 31.9 | 1000000.0 | 1000000.0 |
| M13Hg2.q1t3 | | 577 | | 99.0087 | LMWSSQIII | 9 | 15320.6 | 46.4 | 1000000.0 | 614.0 |
| M13Hg2.q1t3 | | 723 | | 99.0088 | ILNKISSFV | 9 | 17591.1 | 89.9 | 1000000.0 | 1000000.0 |
| Mal_5L10c4.q1t6 | | 334 | | 99.0089 | FVFFIIKNV | 9 | 13366.7 | 53.5 | 1000000.0 | 1000000.0 |
| Mal_5L10c4.q1t6 | | 366 | | 99.0090 | IQICKLYHV | 9 | 8534.4 | 35.2 | 1000000.0 | 1000000.0 |
| Mal_5L10c4.q1t6 | | 534 | | 99.0091 | YISSVNYFL | 9 | 25585.7 | 24.2 | 1000000.0 | 1000000.0 |
| Mal_5L10c4.q1t6 | | 1205 | | 99.0092 | YLFQLVQSL | 9 | 4424.1 | 26.3 | 1000000.0 | 1000000.0 |
| Mal_5L10c4.q1t6 | | 1240 | | 99.0093 | SIYFYWFLL | 9 | 13813.9 | 27.2 | 1000000.0 | 1000000.0 |
| Mal_5L10c4.q1t6 | | 1260 | | 99.0094 | YLHIHKLFI | 9 | 46175.4 | 47.6 | 1000000.0 | 1000000.0 |
| Mal_5L10c4.q1t6 | | 1596 | | 99.0095 | ILDDSINFV | 9 | 8148.9 | 41.5 | 1000000.0 | 1000000.0 |
| Mal_5L10c4.q1t6 | | 1629 | | 99.0096 | FLPEQSYVL | 9 | 36294.8 | 55.0 | 1000000.0 | 1000000.0 |
| Mal_5L10c4.q1t6 | | 1890 | | 99.0097 | HLVIQIIYV | 9 | 52344.4 | 36.6 | 1000000.0 | 1000000.0 |
| Mal_5L10c4.q1t6 | | 2106 | | 99.0098 | FLSVINASV | 9 | 15607.8 | 17.1 | 1000000.0 | 1000000.0 |
| 571.t00003 | Chromosome11 | 105 | | 99.0016 | ILYPSLMPYV | 10 | 1000000.0 | 81.0 | 1000000.0 | 1000000.0 |
| 571.t00003 | Chromosome11 | 2443 | | 99.0017 | YLFGKVKFYI | 10 | 821413.1 | 47.5 | 1000000.0 | 1000000.0 |
| 571.t00003 | Chromosome11 | 68 | | 99.0099 | KLINTNFYI | 9 | 109718.5 | 49.2 | 1000000.0 | 1000000.0 |
| 571.t00003 | Chromosome11 | 92 | | 99.0100 | KTFIYSNFL | 9 | 34260.6 | 95.5 | 1000000.0 | 1000000.0 |
| 571.t00003 | Chromosome11 | 109 | | 99.0101 | SLMPYVECI | 9 | 3307.6 | 80.4 | 1000000.0 | 1000000.0 |
| 571.t00003 | Chromosome11 | 163 | | 99.0102 | YTNYYQSFI | 9 | 14053.9 | 63.6 | 1000000.0 | 1000000.0 |
| 571.t00003 | Chromosome11 | 1224 | | 99.0103 | FQWEKSNKI | 9 | 17731.1 | 88.1 | 1000000.0 | 1000000.0 |
| 571.t00003 | Chromosome11 | 1330 | | 99.0104 | FLIKLNNEI | 9 | 32980.5 | 73.6 | 1000000.0 | 1000000.0 |
| 571.t00003 | Chromosome11 | 1478 | | 99.0105 | YMYTNYLNM | 9 | 5105.1 | 65.8 | 1000000.0 | 4545.4 |
| 571.t00003 | Chromosome11 | 2286 | | 99.0106 | FQGEYVSNL | 9 | 28240.6 | 61.4 | 1000000.0 | 1000000.0 |
| MP03072 | PFC0450w | 7 | CAA15614 | 99.0018 | ILILIDAASV | 10 | 1000000.0 | 88.5 | 1000000.0 | 1000000.0 |
| MP03072 | PFC0450w | 19 | CAA15614 | 99.0019 | LLITFLMINL | 10 | 1000000.0 | 82.3 | 1000000.0 | 1000000.0 |
| MP03072 | PFC0450w | 46 | CAA15614 | 99.0020 | ALVVAIILYV | 10 | 599232.7 | 38.0 | 1000000.0 | 1000000.0 |
| MP03072 | PFC0450w | 50 | CAA15614 | 99.0021 | AIILYVIFLV | 10 | 1000000.0 | 58.1 | 1000000.0 | 1000000.0 |
| MP03072 | PFC0450w | 52 | CAA15614 | 99.0022 | ILYVIFLVLL | 10 | 1000000.0 | 33.8 | 1000000.0 | 1000000.0 |
| MP03072 | PFC0450w | 54 | CAA15614 | 99.0023 | YVIFLVLLFI | 10 | 656413.8 | 20.3 | 1000000.0 | 1000000.0 |
| MP03072 | PFC0450w | 57 | CAA15614 | 99.0024 | FLVLLFIYKA | 10 | 139.6 | 80.7 | 498.9 | 1000000.0 |
| MP03072 | PFC0450w | 18 | CAA15614 | 99.0107 | FLLITFLMI | 9 | 5377.9 | 28.0 | 1000000.0 | 1000000.0 |
| MP03072 | PFC0450w | 47 | CAA15614 | 99.0108 | LVVAIILYV | 9 | 17753.4 | 20.8 | 1000000.0 | 1000000.0 |
| MP03072 | PFC0450w | 50 | CAA15614 | 99.0109 | AIILYVIFL | 9 | 35558.1 | 23.3 | 1000000.0 | 1000000.0 |
| MP03072 | PFC0450w | 51 | CAA15614 | 99.0110 | IILYVIFLV | 9 | 29081.2 | 23.4 | 1000000.0 | 1000000.0 |
| MP03072 | PFC0450w | 52 | CAA15614 | 99.0111 | ILYVIFLVL | 9 | 4626.7 | 49.4 | 1000000.0 | 1000000.0 |
| MP03072 | PFC0450w | 55 | CAA15614 | 99.0112 | VIFLVLLFI | 9 | 17063.1 | 28.6 | 1000000.0 | 1000000.0 |
| 45.t00001 | Chromosome14 | 22 | | 99.0113 | YQDPQNYEL | 9 | 17446.7 | 62.2 | 1000000.0 | 1000000.0 |
| 45.t00001 | Chromosome14 | 134 | | 99.0114 | KTWKPTIFL | 9 | 18939.7 | 82.8 | 1000000.0 | 1000000.0 |
| 45.t00001 | Chromosome14 | 142 | | 99.0115 | LLNESNIFL | 9 | 13381.3 | 66.8 | 1000000.0 | 1000000.0 |
| 45.t00001 | Chromosome14 | 220 | | 99.0116 | FIHFFTWGT | 9 | 54429.1 | 69.2 | 1000000.0 | 1000000.0 |
| MP03137 | PFC0700c | 180 | CAB11150 | 99.0117 | VLFLQMMNV | 9 | 71815.8 | 72.3 | 1000000.0 | 1000000.0 |
| MP03137 | PFC0700c | 251 | CAB11150 | 99.0118 | NQMIFVSSI | 9 | 39082.0 | 99.1 | 1000000.0 | 1000000.0 |
| MP03137 | PFC0700c | 253 | CAB11150 | 99.0119 | MIFVSSIFI | 9 | 17820.1 | 95.9 | 1000000.0 | 1000000.0 |
| MP03137 | PFC0700c | 258 | CAB11150 | 99.0120 | SIFISFYLI | 9 | 13357.1 | 72.3 | 1000000.0 | 1000000.0 |
| MP03137 | PFC0700c | 293 | CAB11150 | 99.0121 | RLFEESLGI | 9 | 22704.6 | 90.4 | 1000000.0 | 1000000.0 |
| 12.t00018 | Chromosome14 | 870 | | 99.0025 | YLCLYNGLLL | 10 | 294216.7 | 79.1 | 1000000.0 | 1000000.0 |
| 12.t00018 | Chromosome14 | 1018 | | 99.0026 | YLLFFREKFL | 10 | 1000000.0 | 57.8 | 1000000.0 | 1000000.0 |
| 12.t00018 | Chromosome14 | 597 | | 99.0122 | KLIEYFLNM | 9 | 8556.1 | 30.0 | 1000000.0 | 1000000.0 |
| 12.t00018 | Chromosome14 | 615 | | 99.0123 | YVSMYIPFI | 9 | 7367.7 | 57.9 | 1000000.0 | 1000000.0 |
| 12.t00018 | Chromosome14 | 870 | | 99.0124 | YLCLYNGLL | 9 | 12899.1 | 68.8 | 1000000.0 | 1000000.0 |
| 12.t00018 | Chromosome14 | 893 | | 99.0125 | NIISSIFYI | 9 | 94922.9 | 77.9 | 1000000.0 | 1000000.0 |
| 12.t00018 | Chromosome14 | 907 | | 99.0126 | YLDNYSHL | 9 | 11094.9 | 55.2 | 1000000.0 | 1000000.0 |
| 12.t00018 | Chromosome14 | 953 | | 99.0127 | FLNVYENFL | 9 | 23398.0 | 34.3 | 1000000.0 | 1000000.0 |
| 12.t00018 | Chromosome14 | 1037 | | 99.0128 | LIFGYNSLI | 9 | 26543.2 | 50.1 | 1000000.0 | 1000000.0 |
| 12.t00018 | Chromosome14 | 1047 | | 99.0129 | FLFYGCREV | 9 | 24096.2 | 30.4 | 1000000.0 | 1000000.0 |
| mal_BU121g9.q1c1 | | 90 | | 99.0130 | YIYIYIYFL | 9 | 32096.6 | 3.8 | 1000000.0 | 1000000.0 |
| mal_BU121g9.q1c1 | | 92 | | 99.0131 | YIYIYFLQI | 9 | 15022.6 | 13.6 | 1000000.0 | 1000000.0 |
| mal_9A57b11.q1t2 | | 138 | | 99.0132 | KQYTDIPSL | 9 | 184531.0 | 81.9 | 1000000.0 | 1000000.0 |
| mal_9A57b11.q1t2 | | 158 | | 99.0133 | KVFCYEYFI | 9 | 10650.1 | 18.0 | 1000000.0 | 1000000.0 |
| mal_9A57b11.q1t2 | | 165 | | 99.0134 | FIFDIFKYA | 9 | 21.1 | 20.2 | 44.0 | 1000000.0 |
| mal_BL50e8.p1ca_5 | | 6 | | 99.0027 | ALLSFLVVLV | 10 | 1000000.0 | 42.5 | 1000000.0 | 1000000.0 |
| mal_BL50e8.p1ca_5 | | 65 | | 99.0028 | RQINFMETFV | 10 | 1000000.0 | 54.6 | 1000000.0 | 1000000.0 |
| mal_BL50e8.p1ca_5 | | 4 | | 99.0135 | FVALLSFLV | 9 | 3130.0 | 26.0 | 1000000.0 | 1000000.0 |

TABLE 4-continued

Pf-derived A2 supertype peptides with PIC <100 nM

| Malaria locus | Addn Source info | Accession Position | Peptide No. | Sequence | AA | A*0101 | PIC A*0201 | A*1101 | A*2402 |
|---|---|---|---|---|---|---|---|---|---|
| mal_BL50e8.p1ca_5 | | 7 | 99.0136 | LLSFLVVLV | 9 | 11579.5 | 36.2 | 1000000.0 | 1000000.0 |
| mal_BL50e8.p1ca_5 | | 192 | 99.0137 | FIYNWVLQT | 9 | 30528.1 | 55.9 | 1000000.0 | 1000000.0 |
| mal_BL50e8.p1ca_5 | | 349 | 99.0138 | ILIRALLSL | 9 | 8963.2 | 44.4 | 1000000.0 | 1000000.0 |
| mal_BL50e8.p1ca_5 | | 353 | 99.0139 | ALLSLDFSL | 9 | 22110.4 | 36.6 | 1000000.0 | 1000000.0 |
| mal_BL50e8.p1ca_5 | | 562 | 99.0140 | NLFGGGFYI | 9 | 22065.3 | 23.4 | 1000000.0 | 1000000.0 |
| mal_BL50e8.p1ca_5 | | 779 | 99.0141 | LMLKADYFI | 9 | 22456.0 | 21.9 | 1000000.0 | 444.0 |
| mal_BL50e8.p1ca_5 | | 973 | 99.0142 | NIYTHSVYV | 9 | 245555.5 | 53.7 | 1000000.0 | 1000000.0 |
| M13S8h6.p1t_3 | | 7 | 99.0143 | FVLACVLLI | 9 | 10293.7 | 14.2 | 1000000.0 | 1000000.0 |
| M13S8h6.p1t_3 | | 23 | 99.0144 | ATSTFFFFL | 9 | 3703.8 | 20.0 | 1000000.0 | 1000000.0 |
| M13S8h6.p1t_3 | | 34 | 99.0145 | FLLICGFCI | 9 | 23058.3 | 21.3 | 1000000.0 | 1000000.0 |
| M13S8h6.p1t_3 | | 55 | 99.0146 | VLITYSFTV | 9 | 35516.3 | 7.8 | 1000000.0 | 1000000.0 |
| M13S8h6.p1t_3 | | 61 | 99.0147 | FTVSYIFFM | 9 | 18627.5 | 9.0 | 1000000.0 | 1000000.0 |
| M13S8h6.p1t_3 | | 77 | 99.0148 | LLVCISILL | 9 | 4378.4 | 24.2 | 1000000.0 | 1000000.0 |
| M13S8h6.p1t_3 | | 1447 | 99.0149 | FIITYIWII | 9 | 50315.1 | 20.9 | 1000000.0 | 1000000.0 |
| M13S8h6.p1t_3 | | 1469 | 99.0150 | KMMWTIFIL | 9 | 13621.2 | 14.7 | 1000000.0 | 35.6 |
| M13S8h6.p1t_3 | | 1538 | 99.0151 | FVFFYIFLI | 9 | 5681.7 | 3.2 | 1000000.0 | 1000000.0 |
| M13S8h6.p1t_3 | | 1582 | 99.0152 | YLDRIQFLV | 9 | 3212.4 | 6.0 | 1000000.0 | 1000000.0 |
| 585.t00002 | Chromosome11 | 651 | 99.0029 | VLSPFSLIFV | 10 | 236320.1 | 33.8 | 1000000.0 | 1000000.0 |
| 585.t00002 | Chromosome11 | 1380 | 99.0030 | TLVNILILFL | 10 | 1000000.0 | 25.5 | 1000000.0 | 1000000.0 |
| 585.t00002 | Chromosome11 | 1406 | 99.0031 | FVFFRLFFFV | 10 | 132657.2 | 16.7 | 1000000.0 | 1000000.0 |
| 585.t00002 | Chromosome11 | 6 | 99.0153 | FILFYFYVM | 9 | 18702.2 | 16.8 | 1000000.0 | 1000000.0 |
| 585.t00002 | Chromosome11 | 17 | 99.0154 | YTFCFLPVL | 9 | 3159.4 | 24.6 | 1000000.0 | 1000000.0 |
| 585.t00002 | Chromosome11 | 643 | 99.0155 | WLFFFDLVV | 9 | 13858.2 | 39.1 | 1000000.0 | 1000000.0 |
| 585.t00002 | Chromosome11 | 661 | 99.0156 | HLFFCIFFI | 9 | 13336.6 | 6.4 | 1000000.0 | 1000000.0 |
| 585.t00002 | Chromosome11 | 1386 | 99.0157 | ILFLICYSI | 9 | 18185.7 | 17.8 | 1000000.0 | 1000000.0 |
| 585.t00002 | Chromosome11 | 1399 | 99.0158 | YMFSYIPFV | 9 | 20964.1 | 1.1 | 1000000.0 | 1000000.0 |
| 585.t00002 | Chromosome11 | 1507 | 99.0159 | YILFILFFI | 9 | 12765.9 | 4.2 | 1000000.0 | 1000000.0 |
| 1223.t00015 | mal_9A21f9.q1t_4 | 1387 | 99.0032 | LIHDDVLLFL | 10 | 1000000.0 | 32.2 | 1000000.0 | 1000000.0 |
| 1223.t00015 | mal_9A21f9.q1t_4 | 270 | 99.0160 | FVSFYKFEV | 9 | 10792.4 | 28.2 | 1000000.0 | 1000000.0 |
| 1223.t00015 | mal_9A21f9.q1t_4 | 811 | 99.0161 | MLWCSMESV | 9 | 5755.3 | 27.5 | 1000000.0 | 1000000.0 |
| 1223.t00015 | mal_9A21f9.q1t_4 | 924 | 99.0162 | KLFDAINYL | 9 | 35603.1 | 20.5 | 1000000.0 | 1000000.0 |
| 1223.t00015 | mal_9A21f9.q1t_4 | 1648 | 99.0163 | FVMDITDSI | 9 | 4215.8 | 44.1 | 1000000.0 | 1000000.0 |
| 1223.t00015 | mal_9A21f9.q1t_4 | 1853 | 99.0164 | MLYSIVWGL | 9 | 18338.7 | 24.8 | 1000000.0 | 1000000.0 |
| 1223.t00015 | mal_9A21f9.q1t_4 | 2301 | 99.0165 | NIYFSYFYV | 9 | 68948.8 | 41.1 | 1000000.0 | 1000000.0 |
| 1223.t00015 | mal_9A21f9.q1t_4 | 2548 | 99.0166 | FILEHVNSI | 9 | 80628.8 | 42.2 | 1000000.0 | 1000000.0 |
| 1223.t00015 | mal_9A21f9.q1t_4 | 3057 | 99.0167 | SLLKAQLFV | 9 | 12372.4 | 15.7 | 1000000.0 | 1000000.0 |
| 1223.t00015 | mal_9A21f9.q1t_4 | 4419 | 99.0168 | SLDEVVLYT | 9 | 8137.8 | 46.3 | 1000000.0 | 1000000.0 |
| 599.t00001 | Chromosome11 | 1069 | 99.0033 | HLMHIINVFI | 10 | 1000000.0 | 56.9 | 1000000.0 | 1000000.0 |
| 599.t00001 | Chromosome11 | 1341 | 99.0034 | FLSDYTTCSV | 10 | 93545.4 | 72.2 | 1000000.0 | 1000000.0 |
| 599.t00001 | Chromosome11 | 1458 | 99.0035 | FLRNYVVIFI | 10 | 615882.5 | 83.6 | 1000000.0 | 1000000.0 |
| 599.t00001 | Chromosome11 | 9 | 99.0169 | YLTINFFIL | 9 | 4373.8 | 64.1 | 1000000.0 | 1000000.0 |
| 599.t00001 | Chromosome11 | 883 | 99.0170 | NMNDIENFV | 9 | 32886.3 | 78.0 | 1000000.0 | 1000000.0 |
| 599.t00001 | Chromosome11 | 1013 | 99.0171 | FIHDILLDL | 9 | 11903.4 | 46.8 | 1000000.0 | 1000000.0 |
| 599.t00001 | Chromosome11 | 1034 | 99.0172 | NQYAYDLKI | 9 | 38604.8 | 81.2 | 1000000.0 | 1000000.0 |
| 599.t00001 | Chromosome11 | 1718 | 99.0173 | GLGGLLFII | 9 | 5216.8 | 74.2 | 1000000.0 | 1000000.0 |
| 599.t00001 | Chromosome11 | 1770 | 99.0174 | YIMNNTIFT | 9 | 4444.5 | 75.2 | 1000000.0 | 1000000.0 |
| 599.t00001 | Chromosome11 | 1914 | 99.0175 | HLFNFSNFV | 9 | 16629.7 | 25.5 | 1000000.0 | 1000000.0 |
| MP01072 | M1045c5.p1c.C_6 | 1138 | 99.0036 | YLIRNILMSI | 10 | 819635.3 | 75.5 | 1000000.0 | 1000000.0 |
| MP01072 | M1045c5.p1c.C_6 | 66 | 99.0176 | YLYKSIFKA | 9 | 6.2 | 29.5 | 1755.3 | 1000000.0 |
| MP01072 | M1045c5.p1c.C_6 | 82 | 99.0177 | YLDFYEFCV | 9 | 5138.7 | 6.7 | 1000000.0 | 1000000.0 |
| MP01072 | M1045c5.p1c.C_6 | 1161 | 99.0178 | KIFFLFFSI | 9 | 19713.1 | 22.7 | 1000000.0 | 1000000.0 |
| MP01072 | M1045c5.p1c.C_6 | 1281 | 99.0179 | KLNEINILL | 9 | 15599.8 | 69.4 | 1000000.0 | 1000000.0 |
| PIR2 | T28161 | 577 | 99.0037 | FLMFWVAHML | 10 | 60152.9 | 33.4 | 1000000.0 | 1000000.0 |
| PIR2 | T28161 | 142 | 99.0180 | LLAEVCYAA | 9 | 9.8 | 35.1 | 4774.0 | 1000000.0 |
| PIR2 | T28161 | 369 | 99.0181 | CLYVCDPYV | 9 | 78244.5 | 58.0 | 1000000.0 | 1000000.0 |
| PIR2 | T28161 | 577 | 99.0182 | FLMFWVAHM | 9 | 3061.0 | 5.7 | 1000000.0 | 1000000.0 |
| PIR2 | T28161 | 642 | 99.0183 | FQGWGHYFV | 9 | 53546.0 | 13.8 | 1000000.0 | 1000000.0 |
| PIR2 | T28161 | 888 | 99.0184 | FLGDVLFAA | 9 | 6.7 | 8.3 | 2549.7 | 1000000.0 |
| PIR2 | T28161 | 892 | 99.0185 | VLFAANYEA | 9 | 25.8 | 20.9 | 100.0 | 1000000.0 |
| PIR2 | T28161 | 1098 | 99.0186 | YLQAQTTAA | 9 | 26.9 | 64.0 | 17290.2 | 1000000.0 |
| PIR2 | T28161 | 1461 | 99.0187 | FLRQMFYTL | 9 | 8779.8 | 60.8 | 1000000.0 | 1000000.0 |
| PIR2 | T28161 | 2149 | 99.0188 | FAAFTYFYL | 9 | 11639.0 | 45.5 | 1000000.0 | 1000000.0 |
| 55.t00004 | Chromosome14 | 1358 | 99.0038 | FMDSQNGMYI | 10 | 26503.4 | 87.2 | 1000000.0 | 4109.6 |
| 55.t00004 | Chromosome14 | 1542 | 99.0039 | SLINYNKYFV | 10 | 1000000.0 | 43.5 | 1000000.0 | 1000000.0 |
| 55.t00004 | Chromosome14 | 84 | 99.0189 | FVVAQLYEL | 9 | 27995.5 | 19.7 | 1000000.0 | 1000000.0 |
| 55.t00004 | Chromosome14 | 480 | 99.0190 | KTFFFFSNV | 9 | 10931.8 | 72.4 | 1000000.0 | 1000000.0 |
| 55.t00004 | Chromosome14 | 1098 | 99.0191 | IINSDDYFV | 9 | 58940.9 | 86.9 | 1000000.0 | 1000000.0 |
| 55.t00004 | Chromosome14 | 1364 | 99.0192 | GMYILPQYV | 9 | 18255.9 | 74.7 | 1000000.0 | 1000000.0 |
| 674.t00001 | Chromosome11 | 89 | 99.0040 | ELVEFIFLLL | 10 | 1000000.0 | 97.4 | 1000000.0 | 1000000.0 |
| 674.t00001 | Chromosome11 | 281 | 99.0041 | FLYKDVLMDI | 10 | 358012.1 | 50.4 | 1000000.0 | 1000000.0 |
| 674.t00001 | Chromosome11 | 89 | 99.0193 | ELVEFIFLL | 9 | 21772.0 | 47.1 | 1000000.0 | 1000000.0 |
| 674.t00001 | Chromosome11 | 1102 | 99.0194 | YLNKANPNI | 9 | 12319.8 | 91.3 | 1000000.0 | 1000000.0 |

TABLE 4-continued

Pf-derived A2 supertype peptides with PIC <100 nM

| Malaria locus | Addn Source info | Position | Accession No. | Peptide No. | Sequence | AA | A*0101 | A*0201 PIC | A*1101 | A*2402 |
|---|---|---|---|---|---|---|---|---|---|---|
| 674.t00001 | Chromosome11 | 1353 | | 99.0195 | FLQYRIPHM | 9 | 33178.8 | 81.0 | 1000000.0 | 1000000.0 |
| 674.t00001 | Chromosome11 | 1430 | | 99.0196 | YIVDIFCKI | 9 | 11720.4 | 48.5 | 1000000.0 | 1000000.0 |

TABLE 5

Pf-derived A3,11 supertype peptides scoring positive on PIC algorithm

| Malaria locus | Addn Source info | Position | Accession No. | Peptide No. | Sequence | AA | A*0101 | A*0201 PIC | A*1101 PIC | A*2402 |
|---|---|---|---|---|---|---|---|---|---|---|
| 331.t00003 | Chromosome10 | 354 | | 99.0197 | KFEPFIIHVK | 10 | 1000000.0 | 1000000.0 | 26.5 | 1000000.0 |
| 331.t00003 | Chromosome10 | 5 | | 99.0294 | KTMDTFYKK | 9 | 2654.1 | 1000000.0 | 0.4 | 1000000.0 |
| 331.t00003 | Chromosome10 | 208 | | 99.0295 | SFFDVSKKK | 9 | 130857.6 | 1000000.0 | 16.4 | 1000000.0 |
| 331.t00003 | Chromosome10 | 435 | | 99.0296 | LSQLVHFYK | 9 | 29656.2 | 1000000.0 | 0.6 | 1000000.0 |
| 331.t00003 | Chromosome10 | 779 | | 99.0297 | SVFVRRYIK | 9 | 18991.0 | 1000000.0 | 0.7 | 1000000.0 |
| 331.t00003 | Chromosome10 | 988 | | 99.0298 | FTFQNMYVR | 9 | 5834.2 | 1000000.0 | 22.0 | 1000000.0 |
| 331.t00003 | Chromosome10 | 1324 | | 99.0299 | SQNSNTFLK | 9 | 10099.5 | 1000000.0 | 0.4 | 1000000.0 |
| 331.t00003 | Chromosome10 | 1337 | | 99.0300 | ILFHKFLNK | 9 | 3064.6 | 1000000.0 | 2.4 | 1000000.0 |
| 331.t00003 | Chromosome10 | 1521 | | 99.0301 | NLFDENFCR | 9 | 30418.9 | 1000000.0 | 165.9 | 1000000.0 |
| 331.t00003 | Chromosome10 | 1551 | | 99.0302 | ALYEKVHGK | 9 | 9346.6 | 1000000.0 | 4.4 | 1000000.0 |
| 18.000811 | Chr12Contig18 | 17 | | 99.0198 | FLLYILFLVK | 10 | 1000000.0 | 1000000.0 | 82.1 | 1000000.0 |
| 18.000811 | Chr12Contig18 | 43 | | 99.0199 | LVFSNVLCFR | 10 | 365585.5 | 1000000.0 | 14.5 | 1000000.0 |
| 18.000811 | Chr12Contig18 | 80 | | 99.0200 | AFLESQSMNK | 10 | 1000000.0 | 1000000.0 | 65.8 | 1000000.0 |
| 18.000811 | Chr12Contig18 | 112 | | 99.0201 | TFLESSFDIK | 10 | 1000000.0 | 1000000.0 | 323.9 | 1000000.0 |
| 18.000811 | Chr12Contig18 | 116 | | 99.0202 | SSFDIKSEVK | 10 | 1000000.0 | 1000000.0 | 34.1 | 1000000.0 |
| 18.000811 | Chr12Contig18 | 18 | | 99.0303 | LLYILFLVK | 9 | 5498.6 | 1000000.0 | 10.1 | 1000000.0 |
| 18.000811 | Chr12Contig18 | 129 | | 99.0304 | KSMLKELIK | 9 | 5942.8 | 1000000.0 | 12.7 | 1000000.0 |
| 18.000811 | Chr12Contig18 | 166 | | 99.0305 | PVLTSLFNK | 9 | 10202.9 | 1000000.0 | 10.1 | 1000000.0 |
| MY924Fe3.p1t1 | | 1262 | | 99.0203 | TFICYYVMDK | 10 | 1000000.0 | 1000000.0 | 23.0 | 1000000.0 |
| MY924Fe3.p1t1 | | 155 | | 99.0306 | NVFNIFFEK | 9 | 10371.6 | 1000000.0 | 0.2 | 1000000.0 |
| MY924Fe3.p1t1 | | 220 | | 99.0307 | SSFLYAFNK | 9 | 12434.3 | 1000000.0 | 0.1 | 1000000.0 |
| MY924Fe3.p1t1 | | 1030 | | 99.0308 | MFHIIMYTK | 9 | 208352.1 | 1000000.0 | 18.2 | 1000000.0 |
| MY924Fe3.p1t1 | | 1181 | | 99.0309 | SLDDIYKYK | 9 | 22644.9 | 1000000.0 | 2.9 | 1000000.0 |
| MY924Fe3.p1t1 | | 1613 | | 99.0310 | KVVVKNLYK | 9 | 34654.1 | 1000000.0 | 0.9 | 1000000.0 |
| MY924Fe3.p1t1 | | 1853 | | 99.0311 | SLFRLGFVK | 9 | 10283.0 | 1000000.0 | 0.2 | 1000000.0 |
| MY924Fe3.p1t1 | | 2012 | | 99.0312 | SLFFNSLYY | 9 | 4.6 | 1000000.0 | 2.6 | 1000000.0 |
| MY924Fe3.p1t1 | | 2238 | | 99.0313 | ITFEKNYYR | 9 | 21591.6 | 1000000.0 | 1.5 | 1000000.0 |
| MY924Fe3.p1t1 | | 2285 | | 99.0314 | SQYEENKSK | 9 | 139775.3 | 1000000.0 | 39.1 | 1000000.0 |
| MP03001 | MAL3P2.11 | 57 | CAB38998 | 99.0204 | KQENWYSLKK | 10 | 1000000.0 | 1000000.0 | 50.6 | 1000000.0 |
| MP03001 | MAL3P2.11 | 335 | CAB38998 | 99.0205 | VTCGNGIQVR | 10 | 1000000.0 | 1000000.0 | 170.6 | 1000000.0 |
| MP03001 | MAL3P2.11 | 17 | CAB38998 | 99.0315 | ALFQEYQCY | 9 | 3.4 | 1000000.0 | 72.7 | 1000000.0 |
| MP03001 | MAL3P2.11 | 57 | CAB38998 | 99.0316 | KQENWYSLK | 9 | 44996.2 | 1000000.0 | 173.7 | 1000000.0 |
| 1369.t00001 | Chromosome11 | 44 | | 99.0206 | TLYQIQVMKR | 10 | 1000000.0 | 1000000.0 | 52.0 | 1000000.0 |
| 1369.t00001 | Chromosome11 | 58 | | 99.0207 | KQVQMMIMIK | 10 | 1000000.0 | 1000000.0 | 8.7 | 1000000.0 |
| 1369.t00001 | Chromosome11 | 70 | | 99.0208 | GVIYIMIISK | 10 | 1000000.0 | 1000000.0 | 10.6 | 1000000.0 |
| 1369.t00001 | Chromosome11 | 158 | | 99.0209 | ELFDKDTFFK | 10 | 1000000.0 | 1000000.0 | 14.2 | 1000000.0 |
| 1369.t00001 | Chromosome11 | 18 | | 99.0317 | KTMNNYMIK | 9 | 16730.1 | 1000000.0 | 1.1 | 1000000.0 |
| 1369.t00001 | Chromosome11 | 159 | | 99.0318 | LFDKDTFFK | 9 | 32977.1 | 1000000.0 | 126.3 | 1000000.0 |
| 1369.t00001 | Chromosome11 | 287 | | 99.0319 | YLFNQHIKK | 9 | 21347.4 | 1000000.0 | 8.2 | 1000000.0 |
| 1369.t00001 | Chromosome11 | 307 | | 99.0320 | MQSSFFMNR | 9 | 12685.3 | 1000000.0 | 25.4 | 1000000.0 |
| 1369.t00001 | Chromosome11 | 315 | | 99.0321 | RFYITTRYK | 9 | 258367.4 | 1000000.0 | 21.4 | 1000000.0 |
| 1369.t00001 | Chromosome11 | 319 | | 99.0322 | TTRYKYLNK | 9 | 10429.2 | 1000000.0 | 4.5 | 1000000.0 |
| 699.t00001 | Chromosome11 | 464 | | 99.0210 | KVCELLGYYK | 10 | 1000000.0 | 1000000.0 | 1.1 | 1000000.0 |
| 699.t00001 | Chromosome11 | 492 | | 99.0211 | SFLLLIVFSK | 10 | 1000000.0 | 1000000.0 | 21.9 | 1000000.0 |
| 699.t00001 | Chromosome11 | 623 | | 99.0212 | KLLYKMNYLK | 10 | 1000000.0 | 1000000.0 | 15.0 | 1000000.0 |
| 699.t00001 | Chromosome11 | 764 | | 99.0213 | TLEYNPSFFY | 10 | 91.9 | 1000000.0 | 219.0 | 1000000.0 |
| 699.t00001 | Chromosome11 | 782 | | 99.0214 | LLYNHITSIK | 10 | 1000000.0 | 1000000.0 | 12.1 | 1000000.0 |
| 699.t00001 | Chromosome11 | 878 | | 99.0215 | LFYLYMNFLK | 10 | 1000000.0 | 1000000.0 | 8.2 | 1000000.0 |
| 699.t00001 | Chromosome11 | 386 | | 99.0323 | KQNIPIYIY | 9 | 57.8 | 1000000.0 | 175.4 | 1000000.0 |
| 699.t00001 | Chromosome11 | 507 | | 99.0324 | KTNIFFKKK | 9 | 23058.6 | 1000000.0 | 1.5 | 1000000.0 |
| 699.t00001 | Chromosome11 | 734 | | 99.0325 | IVNDLGIFY | 9 | 2.4 | 1000000.0 | 16.6 | 1000000.0 |
| 699.t00001 | Chromosome11 | 769 | | 99.0326 | PSFFYLSFK | 9 | 22074.6 | 1000000.0 | 20.1 | 1000000.0 |
| mal_4T2c4.p1t1 | | 15 | | 99.0216 | ILLIRPMLVK | 10 | 1000000.0 | 1000000.0 | 95.1 | 1000000.0 |
| mal_4T2c4.p1t1 | | 29 | | 99.0217 | LVKLRPMLVK | 10 | 1000000.0 | 1000000.0 | 22.3 | 1000000.0 |
| mal_4T2c4.p1t1 | | 36 | | 99.0218 | LVKLGPILVK | 10 | 1000000.0 | 1000000.0 | 15.0 | 1000000.0 |
| mal_4T2c4.p1t1 | | 16 | | 99.0327 | LLIRPMLVK | 9 | 29115.0 | 1000000.0 | 16.1 | 1000000.0 |
| M13Hg2.q1t3 | | 97 | | 99.0219 | LLSRFIFIYK | 10 | 1000000.0 | 1000000.0 | 12.9 | 1000000.0 |
| M13Hg2.q1t3 | | 267 | | 99.0220 | KTSDAKLVDK | 10 | 543207.5 | 1000000.0 | 21.8 | 1000000.0 |

TABLE 5-continued

Pf-derived A3,11 supertype peptides scoring positive on PIC algorithm

| Malaria locus | Addn Source info | Position | Accession No. | Peptide No. | Sequence | AA | A*0101 | PIC A*0201 PIC | A*1101 PIC | A*2402 |
|---|---|---|---|---|---|---|---|---|---|---|
| M13Hg2.q1t3 | | 277 | | 99.0221 | ETSTISTFIK | 10 | 714638.7 | 1000000.0 | 21.8 | 1000000.0 |
| M13Hg2.q1t3 | | 406 | | 99.0222 | IFFSYNPFHK | 10 | 1000000.0 | 1000000.0 | 18.5 | 1000000.0 |
| M13Hg2.q1t3 | | 528 | | 99.0223 | YFFNCIQMAK | 10 | 1000000.0 | 1000000.0 | 48.6 | 1000000.0 |
| M13Hg2.q1t3 | | 9 | | 99.0328 | SLYNKIEYR | 9 | 32837.9 | 1000000.0 | 36.8 | 1000000.0 |
| M13Hg2.q1t3 | | 48 | | 99.0329 | SASESNFYK | 9 | 17208.3 | 1000000.0 | 0.2 | 1000000.0 |
| M13Hg2.q1t3 | | 216 | | 99.0330 | ISYIFPLFK | 9 | 12671.6 | 1000000.0 | 2.2 | 1000000.0 |
| M13Hg2.q1t3 | | 420 | | 99.0331 | SQNYENINK | 9 | 36248.0 | 1000000.0 | 3.6 | 1000000.0 |
| M13Hg2.q1t3 | | 661 | | 99.0332 | SLMDASKNK | 9 | 5327.4 | 1000000.0 | 3.2 | 1000000.0 |
| Mal_5L10c4.q1t6 | | 21 | | 99.0333 | KLGFFVCYK | 9 | 42997.2 | 1000000.0 | 3.5 | 1000000.0 |
| Mal_5L10c4.q1t6 | | 36 | | 99.0334 | SFKNKILQK | 9 | 139254.7 | 1000000.0 | 14.9 | 1000000.0 |
| Mal_5L10c4.q1t6 | | 56 | | 99.0335 | KFMYLRKKK | 9 | 74875.0 | 1000000.0 | 33.4 | 1000000.0 |
| Mal_5L10c4.q1t6 | | 381 | | 99.0336 | KQIIFEALK | 9 | 120283.5 | 1000000.0 | 38.9 | 1000000.0 |
| Mal_5L10c4.q1t6 | | 519 | | 99.0337 | ETFYKELYK | 9 | 14646.9 | 1000000.0 | 1.2 | 1000000.0 |
| Mal_5L10c4.q1t6 | | 537 | | 99.0338 | SVNYFLLER | 9 | 4574.8 | 1000000.0 | 0.4 | 1000000.0 |
| Mal_5L10c4.q1t6 | | 724 | | 99.0339 | ILNFLNFNK | 9 | 12039.7 | 1000000.0 | 2.7 | 1000000.0 |
| Mal_5L10c4.q1t6 | | 897 | | 99.0340 | NTCSKEIYK | 9 | 26259.6 | 1000000.0 | 4.6 | 1000000.0 |
| Mal_5L10c4.q1t6 | | 1316 | | 99.0341 | KLRNFLFYY | 9 | 34.8 | 1000000.0 | 27.7 | 1000000.0 |
| Mal_5L10c4.q1t6 | | 1722 | | 99.0342 | CSNNNIFYK | 9 | 16887.2 | 1000000.0 | 2.7 | 1000000.0 |
| 571.t00003 | Chromosome11 | 1059 | | 99.0224 | MQYNHDNIYK | 10 | 1000000.0 | 1000000.0 | 6.8 | 1000000.0 |
| 571.t00003 | Chromosome11 | 2438 | | 99.0225 | SFSMLYLFGK | 10 | 1000000.0 | 1000000.0 | 20.1 | 1000000.0 |
| 571.t00003 | Chromosome11 | 675 | | 99.0343 | ALNPKYQNH | 9 | 4302.1 | 1000000.0 | 149.6 | 1000000.0 |
| 571.t00003 | Chromosome11 | 749 | | 99.0344 | TLNSFQHNK | 9 | 9140.5 | 1000000.0 | 4.0 | 1000000.0 |
| 571.t00003 | Chromosome11 | 1220 | | 99.0345 | KINEFQWEK | 9 | 55899.8 | 1000000.0 | 0.3 | 1000000.0 |
| 571.t00003 | Chromosome11 | 1368 | | 99.0346 | RSDYFHNTK | 9 | 15625.8 | 1000000.0 | 5.2 | 1000000.0 |
| 571.t00003 | Chromosome11 | 1429 | | 99.0347 | STNSQQLIK | 9 | 14992.1 | 1000000.0 | 1.1 | 1000000.0 |
| 571.t00003 | Chromosome11 | 1552 | | 99.0348 | KFMTPTTLK | 9 | 54389.6 | 1000000.0 | 8.1 | 1000000.0 |
| 571.t00003 | Chromosome11 | 1684 | | 99.0349 | TTNSTPHFK | 9 | 5905.8 | 1000000.0 | 3.8 | 1000000.0 |
| 571.t00003 | Chromosome11 | 2509 | | 99.0350 | KLMETRFSK | 9 | 8313.3 | 1000000.0 | 2.8 | 1000000.0 |
| MP03072 | PFC0450w | 36 | CAA15614 | 99.0226 | SQAHRENGKK | 10 | 1000000.0 | 1000000.0 | 109.2 | 1000000.0 |
| MP03072 | PFC0450w | 45 | CAA15614 | 99.0227 | KALVVAIILY | 10 | 220.1 | 1000000.0 | 237.1 | 1000000.0 |
| MP03072 | PFC0450w | 55 | CAA15614 | 99.0228 | VIFLVLLFIY | 10 | 137.2 | 1000000.0 | 61.8 | 1000000.0 |
| MP03072 | PFC0450w | 56 | CAA15614 | 99.0229 | IFLVLLFIYK | 10 | 1000000.0 | 1000000.0 | 44.3 | 1000000.0 |
| MP03072 | PFC0450w | 58 | CAA15614 | 99.0230 | LVLLFIYKAY | 10 | 371.7 | 1000000.0 | 207.5 | 1000000.0 |
| MP03072 | PFC0450w | 59 | CAA15614 | 99.0231 | VLLFIYKAYK | 10 | 1000000.0 | 1000000.0 | 31.2 | 1000000.0 |
| MP03072 | PFC0450w | 61 | CAA15614 | 99.0232 | LFIYKAYKNK | 10 | 1000000.0 | 1000000.0 | 434.4 | 1000000.0 |
| MP03072 | PFC0450w | 72 | CAA15614 | 99.0233 | KLYTNFFMKK | 10 | 1000000.0 | 1000000.0 | 5.8 | 1000000.0 |
| MP03072 | PFC0450w | 92 | CAA15614 | 99.0234 | STYLSASDEY | 10 | 57.2 | 1000000.0 | 85.1 | 1000000.0 |
| MP03072 | PFC0450w | 36 | CAA15614 | 99.0351 | SQAHRENGK | 9 | 65339.9 | 1000000.0 | 230.0 | 1000000.0 |
| MP03072 | PFC0450w | 46 | CAA15614 | 99.0352 | ALVVAIILY | 9 | 6.0 | 1000000.0 | 95.4 | 1000000.0 |
| MP03072 | PFC0450w | 57 | CAA15614 | 99.0353 | FLVLLFIYK | 9 | 14940.5 | 1000000.0 | 5.0 | 1000000.0 |
| MP03072 | PFC0450w | 58 | CAA15614 | 99.0354 | LVLLFIYKA | 9 | 13.1 | 102.2 | 132.5 | 1000000.0 |
| MP03072 | PFC0450w | 60 | CAA15614 | 99.0355 | LLFIYKAYK | 9 | 59055.3 | 1000000.0 | 9.6 | 1000000.0 |
| MP03072 | PFC0450w | 62 | CAA15614 | 99.0356 | FIYKAYKNK | 9 | 35013.8 | 1000000.0 | 22.0 | 1000000.0 |
| MP03072 | PFC0450w | 72 | CAA15614 | 99.0357 | KLYTNFFMK | 9 | 7491.5 | 1000000.0 | 2.3 | 1000000.0 |
| MP03072 | PFC0450w | 74 | CAA15614 | 99.0358 | YTNFFMKKR | 9 | 18478.3 | 1000000.0 | 48.4 | 1000000.0 |
| 45.t00001 | Chromosome14 | 50 | | 99.0235 | ALERLLSLKK | 10 | 1000000.0 | 1000000.0 | 149.5 | 1000000.0 |
| 45.t00001 | Chromosome14 | 109 | | 99.0236 | KILIKIPVTK | 10 | 1000000.0 | 1000000.0 | 30.2 | 1000000.0 |
| 45.t00001 | Chromosome14 | 128 | | 99.0237 | RLPLLPKTWK | 10 | 1000000.0 | 1000000.0 | 19.6 | 1000000.0 |
| 45.t00001 | Chromosome14 | 147 | | 99.0238 | NIFLRFIPDK | 10 | 1000000.0 | 1000000.0 | 24.9 | 1000000.0 |
| 45.t00001 | Chromosome14 | 161 | | 99.0239 | SQVSNSDSYK | 10 | 1000000.0 | 1000000.0 | 36.0 | 1000000.0 |
| 45.t00001 | Chromosome14 | 197 | | 99.0240 | QQNQESKIMK | 10 | 928526.9 | 1000000.0 | 431.5 | 1000000.0 |
| 45.t00001 | Chromosome14 | 249 | | 99.0241 | IIALLIIPPK | 10 | 1000000.0 | 1000000.0 | 19.3 | 1000000.0 |
| 45.t00001 | Chromosome14 | 374 | | 99.0242 | SQDLACIFDA | 10 | 226.7 | 389.1 | 400.3 | 1000000.0 |
| 45.t00001 | Chromosome14 | 34 | | 99.0359 | AVIFTPIYY | 9 | 7.6 | 1000000.0 | 4.7 | 1000000.0 |
| 45.t00001 | Chromosome14 | 50 | | 99.0360 | ALERLLSLK | 9 | 6245.7 | 1000000.0 | 55.5 | 1000000.0 |
| 45.t00001 | Chromosome14 | 85 | | 99.0361 | SISGKYDIK | 9 | 29562.3 | 1000000.0 | 25.1 | 1000000.0 |
| 45.t00001 | Chromosome14 | 101 | | 99.0362 | ILCIEGEQK | 9 | 51943.1 | 1000000.0 | 162.5 | 1000000.0 |
| 45.t00001 | Chromosome14 | 126 | | 99.0363 | EQRLPLLPK | 9 | 66848.0 | 1000000.0 | 244.3 | 1000000.0 |
| 45.t00001 | Chromosome14 | 148 | | 99.0364 | IFLRFIPDK | 9 | 170326.8 | 1000000.0 | 112.0 | 1000000.0 |
| 45.t00001 | Chromosome14 | 250 | | 99.0365 | IALLIIPPK | 9 | 47443.5 | 1000000.0 | 25.2 | 1000000.0 |
| 45.t00001 | Chromosome14 | 270 | | 99.0366 | PVVCSMEYK | 9 | 20870.3 | 1000000.0 | 23.1 | 1000000.0 |
| 45.t00001 | Chromosome14 | 271 | | 99.0367 | VVCSMEYKK | 9 | 24792.5 | 1000000.0 | 8.3 | 1000000.0 |
| 45.t00001 | Chromosome14 | 308 | | 99.0368 | FSYDLRLNK | 9 | 5228.9 | 1000000.0 | 13.4 | 1000000.0 |
| 45.t00001 | Chromosome14 | 323 | | 99.0369 | HLNIPIGFK | 9 | 25082.0 | 1000000.0 | 98.3 | 1000000.0 |
| MP03137 | PFC0700c | 14 | CAB11150 | 99.0243 | SSPLFNNFYK | 10 | 1000000.0 | 1000000.0 | 0.5 | 1000000.0 |
| MP03137 | PFC0700c | 151 | CAB11150 | 99.0244 | FLYLLNKKNK | 10 | 1000000.0 | 1000000.0 | 139.2 | 1000000.0 |
| MP03137 | PFC0700c | 183 | CAB11150 | 99.0245 | LQMMNVNLQK | 10 | 1000000.0 | 1000000.0 | 83.6 | 1000000.0 |
| MP03137 | PFC0700c | 195 | CAB11150 | 99.0246 | LTNHLINTPK | 10 | 427675.0 | 1000000.0 | 20.8 | 1000000.0 |
| MP03137 | PFC0700c | 259 | CAB11150 | 99.0247 | IFISFYLINK | 10 | 1000000.0 | 1000000.0 | 102.0 | 1000000.0 |
| MP03137 | PFC0700c | 293 | CAB11150 | 99.0248 | RLFEESLGIR | 10 | 923199.1 | 1000000.0 | 420.0 | 1000000.0 |
| MP03137 | PFC0700c | 16 | CAB11150 | 99.0370 | PLFNNFYKR | 9 | 11760.5 | 1000000.0 | 383.0 | 1000000.0 |
| MP03137 | PFC0700c | 141 | CAB11150 | 99.0371 | YQNFQNADK | 9 | 40121.5 | 1000000.0 | 637.4 | 1000000.0 |
| MP03137 | PFC0700c | 184 | CAB11150 | 99.0372 | QMMNVNLQK | 9 | 17662.1 | 1000000.0 | 1.4 | 1000000.0 |

TABLE 5-continued

Pf-derived A3,11 supertype peptides scoring positive on PIC algorithm

| Malaria locus | Addn Source info | Position | Accession No. | Peptide No. | Sequence | AA | A*0101 | PIC A*0201 PIC | A*1101 PIC | A*2402 |
|---|---|---|---|---|---|---|---|---|---|---|
| MP03137 | PFC0700c | 222 | CAB11150 | 99.0373 | AVSEIQNNK | 9 | 6991.0 | 1000000.0 | 3.1 | 1000000.0 |
| MP03137 | PFC0700c | 236 | CAB11150 | 99.0374 | GTMYILLKK | 9 | 986.2 | 1000000.0 | 0.5 | 1000000.0 |
| MP03137 | PFC0700c | 260 | CAB11150 | 99.0375 | FISFYLINK | 9 | 7376.0 | 1000000.0 | 12.2 | 1000000.0 |
| MP03137 | PFC0700c | 264 | CAB11150 | 99.0376 | YLINKHWQR | 9 | 39562.3 | 1000000.0 | 41.6 | 1000000.0 |
| MP03137 | PFC0700c | 273 | CAB11150 | 99.0377 | ALKISQLQK | 9 | 37884.8 | 1000000.0 | 5.1 | 1000000.0 |
| MP03137 | PFC0700c | 282 | CAB11150 | 99.0378 | KINSNFLLK | 9 | 5732.3 | 1000000.0 | 1.0 | 1000000.0 |
| 12.t00018 | Chromosome14 | 89 | | 99.0249 | QLKHFFNSNK | 10 | 1000000.0 | 1000000.0 | 33.5 | 1000000.0 |
| 12.t00018 | Chromosome14 | 615 | | 99.0250 | YVSMYIPFIK | 10 | 301060.0 | 1000000.0 | 2.6 | 1000000.0 |
| 12.t00018 | Chromosome14 | 671 | | 99.0251 | VLFYIYNMYH | 10 | 900700.0 | 1000000.0 | 13.6 | 1000000.0 |
| 12.t00018 | Chromosome14 | 705 | | 99.0252 | YTYIFFNYDK | 10 | 742244.6 | 1000000.0 | 2.1 | 1000000.0 |
| 12.t00018 | Chromosome14 | 1140 | | 99.0253 | SFFITYSYWK | 10 | 1000000.0 | 1000000.0 | 5.7 | 1000000.0 |
| 12.t00018 | Chromosome14 | 195 | | 99.0379 | STSNKHINR | 9 | 6609.8 | 1000000.0 | 3.8 | 1000000.0 |
| 12.t00018 | Chromosome14 | 687 | | 99.0380 | SQCNDYYIK | 9 | 95255.3 | 1000000.0 | 6.3 | 1000000.0 |
| 12.t00018 | Chromosome14 | 896 | | 99.0381 | SSIFYIKNK | 9 | 41588.5 | 1000000.0 | 8.4 | 1000000.0 |
| 12.t00018 | Chromosome14 | 1020 | | 99.0382 | LFFREKFLK | 9 | 89243.3 | 1000000.0 | 14.3 | 1000000.0 |
| 12.t00018 | Chromosome14 | 1160 | | 99.0383 | ILDNVSFLK | 9 | 7621.1 | 1000000.0 | 21.0 | 1000000.0 |
| mal_BU121g9.q1c1 | | 10 | | 99.0254 | ILVLDIPGFK | 10 | 1000000.0 | 1000000.0 | 55.0 | 1000000.0 |
| mal_BU121g9.q1c1 | | 45 | | 99.0255 | ETYGDSLVLH | 10 | 453286.5 | 1000000.0 | 386.1 | 1000000.0 |
| mal_BU121g9.q1c1 | | 59 | | 99.0256 | EVGYFKRIFK | 10 | 1000000.0 | 1000000.0 | 20.4 | 1000000.0 |
| mal_BU121g9.q1c1 | | 11 | | 99.0384 | LVLDIPGFK | 9 | 13172.2 | 1000000.0 | 26.7 | 1000000.0 |
| mal_BU121g9.q1c1 | | 30 | | 99.0385 | GMLTVAGPR | 9 | 54761.5 | 1000000.0 | 326.1 | 1000000.0 |
| mal_BU121g9.q1c1 | | 39 | | 99.0386 | SQTELFETY | 9 | 6.7 | 1000000.0 | 254.2 | 1000000.0 |
| mal_BU121g9.q1c1 | | 48 | | 99.0387 | GDSLVLHAK | 9 | 19504.9 | 1000000.0 | 306.8 | 1000000.0 |
| mal_BU121g9.q1c1 | | 50 | | 99.0388 | SLVLHAKER | 9 | 133501.5 | 1000000.0 | 487.4 | 1000000.0 |
| mal_BU121g9.q1c1 | | 60 | | 99.0389 | VGYFKRIFK | 9 | 44416.3 | 1000000.0 | 27.9 | 1000000.0 |
| mal_BU121g9.q1c1 | | 86 | | 99.0390 | NIYIYIYIY | 9 | 40.2 | 1000000.0 | 322.7 | 1000000.0 |
| mal_BU121g9.q1c1 | | 88 | | 99.0391 | YIYIYIYIY | 9 | 16.2 | 1000000.0 | 310.0 | 1000000.0 |
| mal_9A57b11.q1t2 | | 31 | | 99.0257 | SSFNCDIANK | 10 | 1000000.0 | 1000000.0 | 8.4 | 1000000.0 |
| mal_9A57b11.q1t2 | | 49 | | 99.0258 | SMGVFCLKEK | 10 | 1000000.0 | 1000000.0 | 24.6 | 1000000.0 |
| mal_9A57b11.q1t2 | | 119 | | 99.0259 | HIVKNRIYNK | 10 | 1000000.0 | 1000000.0 | 51.7 | 1000000.0 |
| mal_9A57b11.q1t2 | | 128 | | 99.0260 | KLKLHKIIRK | 10 | 1000000.0 | 1000000.0 | 64.9 | 1000000.0 |
| mal_9A57b11.q1t2 | | 165 | | 99.0261 | FIFDIFKYAR | 10 | 1000000.0 | 1000000.0 | 148.8 | 1000000.0 |
| mal_9A57b11.q1t2 | | 202 | | 99.0262 | AQKALSNLHK | 10 | 1000000.0 | 1000000.0 | 113.8 | 1000000.0 |
| mal_9A57b11.q1t2 | | 208 | | 99.0263 | NLHKSWLQYK | 10 | 507559.4 | 1000000.0 | 199.6 | 1000000.0 |
| mal_9A57b11.q1t2 | | 234 | | 99.0264 | YLPLFLMMEH | 10 | 1000000.0 | 1000000.0 | 147.3 | 1000000.0 |
| mal_9A57b11.q1t2 | | 32 | | 99.0392 | SFNCDIANK | 9 | 27329.1 | 1000000.0 | 35.4 | 1000000.0 |
| mal_9A57b11.q1t2 | | 62 | | 99.0393 | KINKKYNKK | 9 | 40379.4 | 1000000.0 | 56.4 | 1000000.0 |
| mal_9A57b11.q1t2 | | 95 | | 99.0394 | ILNNKELFK | 9 | 13663.7 | 1000000.0 | 29.6 | 1000000.0 |
| mal_9A57b11.q1t2 | | 120 | | 99.0395 | IVKNRIYNK | 9 | 25949.5 | 1000000.0 | 17.8 | 1000000.0 |
| mal_9A57b11.q1t2 | | 154 | | 99.0396 | LINSKVFCY | 9 | 6.1 | 1000000.0 | 113.8 | 1000000.0 |
| mal_9A57b11.q1t2 | | 183 | | 99.0397 | RQKEFYPIK | 9 | 127059.4 | 1000000.0 | 38.7 | 1000000.0 |
| mal_BL50e8.p1ca_5 | | 9 | | 99.0265 | SFLVVLVFNK | 10 | 1000000.0 | 1000000.0 | 33.6 | 1000000.0 |
| mal_BL50e8.p1ca_5 | | 152 | | 99.0266 | STYMTPSAIK | 10 | 1000000.0 | 1000000.0 | 2.8 | 1000000.0 |
| mal_BL50e8.p1ca_5 | | 656 | | 99.0267 | KLYGEFTMNK | 10 | 1000000.0 | 1000000.0 | 1.3 | 1000000.0 |
| mal_BL50e8.p1ca_5 | | 907 | | 99.0268 | GVYYIFVYLR | 10 | 1000000.0 | 1000000.0 | 3.7 | 1000000.0 |
| mal_BL50e8.p1ca_5 | | 115 | | 99.0398 | SQYSNYFDY | 9 | 11.0 | 1000000.0 | 15.2 | 1000000.0 |
| mal_BL50e8.p1ca_5 | | 361 | | 99.0399 | LFITYFQQK | 9 | 90294.9 | 1000000.0 | 50.9 | 1000000.0 |
| mal_BL50e8.p1ca_5 | | 409 | | 99.0400 | ATSWDEYPK | 9 | 44148.4 | 1000000.0 | 0.8 | 1000000.0 |
| mal_BL50e8.p1ca_5 | | 752 | | 99.0401 | ASFAAHENK | 9 | 11256.9 | 1000000.0 | 0.2 | 1000000.0 |
| mal_BL50e8.p1ca_5 | | 780 | | 99.0402 | MLKADYFIR | 9 | 35925.9 | 1000000.0 | 61.1 | 1000000.0 |
| mal_BL50e8.p1ca_5 | | 819 | | 99.0403 | VLNPVTIPK | 9 | 14931.7 | 1000000.0 | 5.6 | 1000000.0 |
| M13S8h6.p1t_3 | | 63 | | 99.0269 | VSYIFFMSFK | 10 | 1000000.0 | 1000000.0 | 0.4 | 1000000.0 |
| M13S8h6.p1t_3 | | 937 | | 99.0270 | MQKYFLHISK | 10 | 1000000.0 | 1000000.0 | 37.5 | 1000000.0 |
| M13S8h6.p1t_3 | | 25 | | 99.0404 | STFFFFLSR | 9 | 3848.4 | 1000000.0 | 0.1 | 1000000.0 |
| M13S8h6.p1t_3 | | 84 | | 99.0405 | LLLTFGVYY | 9 | 22.7 | 1000000.0 | 157.5 | 1000000.0 |
| M13S8h6.p1t_3 | | 157 | | 99.0406 | KFLFRYKQK | 9 | 941796.8 | 1000000.0 | 16.1 | 1000000.0 |
| M13S8h6.p1t_3 | | 394 | | 99.0407 | KVFIKGKGK | 9 | 43309.1 | 1000000.0 | 3.8 | 1000000.0 |
| M13S8h6.p1t_3 | | 1449 | | 99.0408 | ITYIWIILK | 9 | 6990.4 | 1000000.0 | 1.6 | 1000000.0 |
| M13S8h6.p1t_3 | | 1534 | | 99.0409 | KFFFFVFFY | 9 | 51.8 | 1000000.0 | 3.5 | 2.2 |
| M13S8h6.p1t_3 | | 1655 | | 99.0410 | KLLQKLISK | 9 | 8661.9 | 1000000.0 | 53.4 | 1000000.0 |
| M13S8h6.p1t_3 | | 1703 | | 99.0411 | ILNILKLAK | 9 | 21447.1 | 1000000.0 | 55.0 | 1000000.0 |
| 585.t00002 | Chromosome11 | 193 | | 99.0412 | SQNNFSKIK | 9 | 90378.2 | 1000000.0 | 9.1 | 1000000.0 |
| 585.t00002 | Chromosome11 | 300 | | 99.0413 | SSLNIYNTK | 9 | 46908.8 | 1000000.0 | 5.2 | 1000000.0 |
| 585.t00002 | Chromosome11 | 529 | | 99.0414 | KLFNYKFFK | 9 | 60297.3 | 1000000.0 | 1.0 | 1000000.0 |
| 585.t00002 | Chromosome11 | 572 | | 99.0415 | LTFLSNIRK | 9 | 13099.9 | 1000000.0 | 1.3 | 1000000.0 |
| 585.t00002 | Chromosome11 | 616 | | 99.0416 | KFFYIFHYK | 9 | 49030.6 | 1000000.0 | 0.2 | 1000000.0 |
| 585.t00002 | Chromosome11 | 1415 | | 99.0417 | VTCSYFIIR | 9 | 6831.4 | 1000000.0 | 16.8 | 1000000.0 |
| 585.t00002 | Chromosome11 | 1487 | | 99.0418 | LTCAFKIYK | 9 | 25752.8 | 1000000.0 | 0.3 | 1000000.0 |
| 585.t00002 | Chromosome11 | 1508 | | 99.0419 | ILFILFFIK | 9 | 9492.2 | 1000000.0 | 1.2 | 1000000.0 |
| 585.t00002 | Chromosome11 | 1541 | | 99.0420 | NLYFFIHNR | 9 | 13239.8 | 1000000.0 | 59.3 | 1000000.0 |
| 585.t00002 | Chromosome11 | 1742 | | 99.0421 | IFLHYYFKK | 9 | 118461.5 | 1000000.0 | 7.6 | 1000000.0 |
| 1223.t00015 | mal_9A21f9.q1t_4 | 4294 | | 99.0271 | QVFFLQEMER | 10 | 544655.4 | 1000000.0 | 27.6 | 1000000.0 |
| 1223.t00015 | mal_9A21f9.q1t_4 | 272 | | 99.0422 | SFYKFEVEK | 9 | 193104.9 | 1000000.0 | 16.1 | 1000000.0 |

TABLE 5-continued

Pf-derived A3,11 supertype peptides scoring positive on PIC algorithm

| Malaria locus | Addn Source info | Position | Accession No. | Peptide No. | Sequence | AA | A*0101 | PIC A*0201 PIC | A*1101 PIC | A*2402 |
|---|---|---|---|---|---|---|---|---|---|---|
| 1223.t00015 | mal_9A21f9.q1t_4 | 325 | | 99.0423 | KTFREHFLK | 9 | 17344.2 | 1000000.0 | 0.022 | 1000000.0 |
| 1223.t00015 | mal_9A21f9.q1t_4 | 992 | | 99.0424 | VSNSSQLFK | 9 | 13528.2 | 1000000.0 | 5.1 | 1000000.0 |
| 1223.t00015 | mal_9A21f9.q1t_4 | 1397 | | 99.0425 | SLLNDVFPK | 9 | 67376.3 | 1000000.0 | 1.2 | 1000000.0 |
| 1223.t00015 | mal_9A21f9.q1t_4 | 1627 | | 99.0426 | KLFIFYLDK | 9 | 25288.3 | 1000000.0 | 0.67 | 1000000.0 |
| 1223.t00015 | mal_9A21f9.q1t_4 | 1664 | | 99.0427 | LLNSQIIQY | 9 | 18.6 | 1000000.0 | 160.0 | 1000000.0 |
| 1223.t00015 | mal_9A21f9.q1t_4 | 2115 | | 99.0428 | FQGFYFLDK | 9 | 6204.2 | 1000000.0 | 44.3 | 1000000.0 |
| 1223.t00015 | mal_9A21f9.q1t_4 | 2412 | | 99.0429 | NTFSFSWMK | 9 | 16414.9 | 1000000.0 | 0.20 | 1000000.0 |
| 1223.t00015 | mal_9A21f9.q1t_4 | 4500 | | 99.0430 | MFYNCPVYK | 9 | 327575.1 | 1000000.0 | 10.3 | 1000000.0 |
| 599.t00001 | Chromosome11 | 723 | | 99.0272 | NLLRHAIFYK | 10 | 1000000.0 | 1000000.0 | 7.4 | 1000000.0 |
| 599.t00001 | Chromosome11 | 1288 | | 99.0273 | SSYGYNIYFK | 10 | 1000000.0 | 1000000.0 | 0.3 | 1000000.0 |
| 599.t00001 | Chromosome11 | 1451 | | 99.0274 | RTYVNEYFLR | 10 | 1000000.0 | 1000000.0 | 25.4 | 1000000.0 |
| 599.t00001 | Chromosome11 | 16 | | 99.0431 | ILLTLVFQK | 9 | 46527.3 | 1000000.0 | 2.9 | 1000000.0 |
| 599.t00001 | Chromosome11 | 28 | | 99.0432 | CQNSLNYSK | 9 | 38238.7 | 1000000.0 | 63.2 | 1000000.0 |
| 599.t00001 | Chromosome11 | 211 | | 99.0433 | IVNNTELNK | 9 | 9493.8 | 1000000.0 | 3.6 | 1000000.0 |
| 599.t00001 | Chromosome11 | 776 | | 99.0434 | TLFSQNLFY | 9 | 10.5 | 1000000.0 | 75.0 | 1000000.0 |
| 599.t00001 | Chromosome11 | 1320 | | 99.0435 | TFYESVFTR | 9 | 63945.9 | 1000000.0 | 27.9 | 1000000.0 |
| 599.t00001 | Chromosome11 | 1370 | | 99.0436 | YFFEEFFNK | 9 | 19717.0 | 1000000.0 | 4.6 | 1000000.0 |
| 599.t00001 | Chromosome11 | 1903 | | 99.0437 | TTQSNNIYK | 9 | 20011.8 | 1000000.0 | 2.1 | 1000000.0 |
| MP01072 | M1045c5.p1c.C_6 | 1451 | | 99.0275 | SLFYFTSNGK | 10 | 1000000.0 | 1000000.0 | 8.0 | 1000000.0 |
| MP01072 | M1045c5.p1c.C_6 | 46 | | 99.0438 | KLNYDNFEK | 9 | 48445.0 | 1000000.0 | 3.4 | 1000000.0 |
| MP01072 | M1045c5.p1c.C_6 | 327 | | 99.0439 | ILCDDGIYR | 9 | 19413.7 | 1000000.0 | 65.3 | 1000000.0 |
| MP01072 | M1045c5.p1c.C_6 | 359 | | 99.0440 | KVADVFLQH | 9 | 6428.6 | 1000000.0 | 4.4 | 1000000.0 |
| MP01072 | M1045c5.p1c.C_6 | 419 | | 99.0441 | STSFLFLRK | 9 | 2370.1 | 1000000.0 | 0.2 | 1000000.0 |
| MP01072 | M1045c5.p1c.C_6 | 421 | | 99.0442 | SFLFLRKQK | 9 | 408258.6 | 1000000.0 | 12.7 | 1000000.0 |
| MP01072 | M1045c5.p1c.C_6 | 558 | | 99.0443 | SFFSSCENK | 9 | 55537.2 | 1000000.0 | 17.7 | 1000000.0 |
| MP01072 | M1045c5.p1c.C_6 | 609 | | 99.0444 | AQSSYIYNK | 9 | 18056.8 | 1000000.0 | 2.5 | 1000000.0 |
| MP01072 | M1045c5.p1c.C_6 | 1027 | | 99.0445 | MSAKYLYHK | 9 | 5370.6 | 1000000.0 | 8.8 | 1000000.0 |
| MP01072 | M1045c5.p1c.C_6 | 1047 | | 99.0446 | TTLFSHFNK | 9 | 10524.0 | 1000000.0 | 0.2 | 1000000.0 |
| MP01072 | M1045c5.p1c.C_6 | 1215 | | 99.0447 | SVYYNTMLR | 9 | 9856.9 | 1000000.0 | 1.2 | 1000000.0 |
| PIR2 | T28161 | 1124 | | 99.0276 | VVNFLFELYK | 10 | 408697.6 | 1000000.0 | 3.5 | 1000000.0 |
| PIR2 | T28161 | 1403 | | 99.0277 | TFFLWDRYKK | 10 | 1000000.0 | 1000000.0 | 9.0 | 1000000.0 |
| PIR2 | T28161 | 108 | | 99.0448 | SVGACAPYR | 9 | 59804.6 | 1000000.0 | 2.1 | 1000000.0 |
| PIR2 | T28161 | 204 | | 99.0449 | KQLEDNLRK | 9 | 87893.1 | 1000000.0 | 16.9 | 1000000.0 |
| PIR2 | T28161 | 758 | | 99.0450 | KVASNMHHK | 9 | 6948.7 | 1000000.0 | 1.6 | 1000000.0 |
| PIR2 | T28161 | 760 | | 99.0451 | ASNMHHKKK | 9 | 32965.2 | 1000000.0 | 4.3 | 1000000.0 |
| PIR2 | T28161 | 838 | | 99.0452 | AGFISNTYK | 9 | 154161.8 | 1000000.0 | 2.2 | 1000000.0 |
| PIR2 | T28161 | 965 | | 99.0453 | ILAFKEIYK | 9 | 14274.5 | 1000000.0 | 12.6 | 1000000.0 |
| PIR2 | T28161 | 1879 | | 99.0454 | ALFKRWLEY | 9 | 3.4 | 1000000.0 | 27.4 | 1000000.0 |
| PIR2 | T28161 | 2151 | | 99.0455 | AFTYFYLKK | 9 | 40565.6 | 1000000.0 | 1.6 | 1000000.0 |
| 55.t00004 | Chromosome14 | 483 | | 99.0278 | FFFSNVNNNK | 10 | 409139.5 | 1000000.0 | 408.4 | 1000000.0 |
| 55.t00004 | Chromosome14 | 564 | | 99.0279 | SQGKKNTYLK | 10 | 1000000.0 | 1000000.0 | 13.0 | 1000000.0 |
| 55.t00004 | Chromosome14 | 976 | | 99.0280 | VFNNSIILEK | 10 | 1000000.0 | 1000000.0 | 372.4 | 1000000.0 |
| 55.t00004 | Chromosome14 | 1338 | | 99.0281 | SVSEGYTSTY | 10 | 67.8 | 1000000.0 | 33.5 | 1000000.0 |
| 55.t00004 | Chromosome14 | 229 | | 99.0456 | TSICKYWIK | 9 | 8242.3 | 1000000.0 | 14.6 | 1000000.0 |
| 55.t00004 | Chromosome14 | 263 | | 99.0457 | TTICKHWKK | 9 | 4558.7 | 1000000.0 | 1.7 | 1000000.0 |
| 55.t00004 | Chromosome14 | 537 | | 99.0458 | KVTNVHIYK | 9 | 41321.8 | 1000000.0 | 0.2 | 1000000.0 |
| 55.t00004 | Chromosome14 | 866 | | 99.0459 | ITNMNNINR | 9 | 5371.8 | 1000000.0 | 37.6 | 1000000.0 |
| 55.t00004 | Chromosome14 | 909 | | 99.0460 | MLNIYKINK | 9 | 17179.3 | 1000000.0 | 13.6 | 1000000.0 |
| 55.t00004 | Chromosome14 | 1030 | | 99.0461 | IINSYIDYK | 9 | 84561.6 | 1000000.0 | 2.0 | 1000000.0 |
| 55.t00004 | Chromosome14 | 1141 | | 99.0462 | NLYTYVVNK | 9 | 45076.1 | 1000000.0 | 54.8 | 1000000.0 |
| 55.t00004 | Chromosome14 | 1665 | | 99.0463 | KMIYSIFIK | 9 | 42191.9 | 1000000.0 | 4.1 | 1000000.0 |
| 13.t00011 | Chromosome14 | 8 | | 99.0282 | ISMDKSLFFK | 10 | 1000000.0 | 1000000.0 | 16.7 | 1000000.0 |
| 13.t00011 | Chromosome14 | 47 | | 99.0283 | TVFLDYVKGK | 10 | 1000000.0 | 1000000.0 | 7.8 | 1000000.0 |
| 13.t00011 | Chromosome14 | 59 | | 99.0284 | DVYKETNMNR | 10 | 1000000.0 | 1000000.0 | 64.9 | 1000000.0 |
| 13.t00011 | Chromosome14 | 117 | | 99.0285 | KLKKSTICNK | 10 | 1000000.0 | 1000000.0 | 59.9 | 1000000.0 |
| 13.t00011 | Chromosome14 | 9 | | 99.0464 | SMDKSLFFK | 9 | 4208.2 | 1000000.0 | 3.5 | 1000000.0 |
| 13.t00011 | Chromosome14 | 12 | | 99.0465 | KSLFFKSLK | 9 | 64105.1 | 1000000.0 | 17.4 | 1000000.0 |
| 13.t00011 | Chromosome14 | 48 | | 99.0466 | VFLDYVKGK | 9 | 347222.4 | 1000000.0 | 216.7 | 1000000.0 |
| 13.t00011 | Chromosome14 | 93 | | 99.0467 | KVKRFRVFK | 9 | 52490.3 | 1000000.0 | 3.3 | 1000000.0 |
| 13.t00011 | Chromosome14 | 104 | | 99.0468 | SFFIDEVKK | 9 | 352606.0 | 1000000.0 | 37.8 | 1000000.0 |
| 13.t00011 | Chromosome14 | 112 | | 99.0469 | KIYENKLKK | 9 | 30696.4 | 1000000.0 | 14.5 | 1000000.0 |
| 37.t00002 | Chromosome14 | 13 | | 99.0286 | ALTYMYCVYY | 10 | 249.1 | 1000000.0 | 112.8 | 1000000.0 |
| 37.t00002 | Chromosome14 | 31 | | 99.0287 | SQISIFCNLR | 10 | 1000000.0 | 1000000.0 | 226.6 | 1000000.0 |
| 37.t00002 | Chromosome14 | 32 | | 99.0288 | QISIFCNLRR | 10 | 301919.5 | 1000000.0 | 80.8 | 1000000.0 |
| 37.t00002 | Chromosome14 | 62 | | 99.0289 | VCNNETYYNK | 10 | 1000000.0 | 1000000.0 | 186.8 | 1000000.0 |
| 37.t00002 | Chromosome14 | 71 | | 99.0290 | KAHEENDKVK | 10 | 1000000.0 | 1000000.0 | 956.7 | 1000000.0 |
| 37.t00002 | Chromosome14 | 13 | | 99.0470 | ALTYMYCVY | 9 | 9.1 | 1000000.0 | 279.6 | 1000000.0 |
| 37.t00002 | Chromosome14 | 32 | | 99.0471 | QISIFCNLR | 9 | 26897.2 | 1000000.0 | 855.0 | 1000000.0 |
| 37.t00002 | Chromosome14 | 33 | | 99.0472 | ISIFCNLRR | 9 | 37287.9 | 1000000.0 | 255.9 | 1000000.0 |
| 37.t00002 | Chromosome14 | 61 | | 99.0473 | NVCNNETYY | 9 | 25.3 | 1000000.0 | 514.8 | 1000000.0 |
| 674.t00001 | Chromosome11 | 90 | | 99.0291 | LVEFIFLLK | 10 | 304423.1 | 1000000.0 | 13.7 | 1000000.0 |
| 674.t00001 | Chromosome11 | 218 | | 99.0292 | SVFYNKEIIK | 10 | 993500.3 | 1000000.0 | 4.5 | 1000000.0 |
| 674.t00001 | Chromosome11 | 867 | | 99.0293 | SLKDFDMLLY | 10 | 199.3 | 1000000.0 | 214.4 | 1000000.0 |

TABLE 5-continued

Pf-derived A3,11 supertype peptides scoring positive on PIC algorithm

| Malaria locus | Addn Source info | Position | Accession No. | Peptide No. | Sequence | AA | A*0101 | A*0201 PIC | A*1101 PIC | A*2402 |
|---|---|---|---|---|---|---|---|---|---|---|
| 674.t00001 | Chromosome11 | 64 | | 99.0474 | NVNDRFVEK | 9 | 13728.8 | 1000000.0 | 11.8 | 1000000.0 |
| 674.t00001 | Chromosome11 | 662 | | 99.0475 | TLSNSLPQK | 9 | 36834.4 | 1000000.0 | 47.0 | 1000000.0 |
| 674.t00001 | Chromosome11 | 673 | | 99.0476 | YQINNFIHK | 9 | 12103.7 | 1000000.0 | 59.8 | 1000000.0 |
| 674.t00001 | Chromosome11 | 689 | | 99.0477 | NLTINNFQK | 9 | 59129.2 | 1000000.0 | 40.3 | 1000000.0 |
| 674.t00001 | Chromosome11 | 1035 | | 99.0478 | KFNRDMLQK | 9 | 254779.4 | 1000000.0 | 1.9 | 1000000.0 |
| 674.t00001 | Chromosome11 | 1126 | | 99.0479 | NQSDFLLLK | 9 | 8015.9 | 1000000.0 | 15.2 | 1000000.0 |
| 674.t00001 | Chromosome11 | 1256 | | 99.0480 | SFHHFNIDK | 9 | 178323.3 | 1000000.0 | 26.2 | 1000000.0 |
| 674.t00001 | Chromosome11 | 1288 | | 99.0481 | KSKELLLQK | 9 | 27230.7 | 1000000.0 | 4.4 | 1000000.0 |

TABLE 6

Pf-derived 15mer peptides with nonamer core sequences scoring DR1 PIC <4 nM

| Antigen | Addn Source info | Position | Peptide No. | Sequence | AA | DR1 PIC |
|---|---|---|---|---|---|---|
| 331.t00003 | Chromosome10 | 182 | 100.0001 | LSHFKKNFILQNNEE | 15 | 0.447 |
| 331.t00003 | Chromosome10 | 365 | 100.0002 | TTFLSALKLLKIAQY | 15 | 0.400 |
| 331.t00003 | Chromosome10 | 428 | 100.0003 | NNKLSKNLSQLVHFY | 15 | 0.130 |
| 331.t00003 | Chromosome10 | 617 | 100.0004 | KIYMFGGFSKGVRNN | 15 | 0.061 |
| 331.t00003 | Chromosome10 | 894 | 100.0005 | DDMIGMPNLSSTVVC | 15 | 0.337 |
| 331.t00003 | Chromosome10 | 987 | 100.0006 | TFTFQNMYVRSKVVS | 15 | 0.400 |
| 331.t00003 | Chromosome10 | 1365 | 100.0007 | KYEIIGNILIFHYKY | 15 | 0.435 |
| 331.t00003 | Chromosome10 | 1601 | 100.0008 | KERMKNMYIVSNNDD | 15 | 0.013 |
| 331.t00003 | Chromosome10 | 1656 | 100.0009 | GVGYFTLPLLKCIEA | 15 | 0.302 |
| 331.t00003 | Chromosome10 | 1725 | 100.0010 | HRIILGLLPHSQPAW | 15 | 0.167 |
| Chr12Contig18 | 18.000811 | 13 | 100.0011 | HFFLFLLYILFLVKM | 15 | 1.826 |
| Chr12Contig18 | 18.000811 | 16 | 100.0012 | LFLLYILFLVKMNAL | 15 | 0.593 |
| Chr12Contig18 | 18.000811 | 21 | 100.0013 | ILFLVKMNALRRLPV | 15 | 0.035 |
| Chr12Contig18 | 18.000811 | 27 | 100.0014 | MNALRRLPVICSFLV | 15 | 3.206 |
| Chr12Contig18 | 18.000811 | 79 | 100.0015 | SAFLESQSMNKIGDD | 15 | 3.392 |
| Chr12Contig18 | 18.000811 | 132 | 100.0016 | LKELIKVGLPSFENL | 15 | 0.785 |
| Chr12Contig18 | 18.000811 | 143 | 100.0017 | FENLVAENVKPPKVD | 15 | 0.854 |
| Chr12Contig18 | 18.000811 | 148 | 100.0018 | AENVKPPKVDPATYG | 15 | 3.392 |
| Chr12Contig18 | 18.000811 | 158 | 100.0019 | PATYGIIVPVLTSLF | 15 | 0.221 |
| Chr12Contig18 | 18.000811 | 161 | 100.0020 | YGIIVPVLTSLFNKV | 15 | 0.956 |
| MY924Fe3.p1t1 | | 1015 | 100.0021 | SVDLQIKISMKVLNS | 15 | 0.103 |
| MY924Fe3.p1t1 | | 1021 | 100.0022 | KISMKVLNSMFHIIM | 15 | 0.234 |
| MY924Fe3.p1t1 | | 1076 | 100.0023 | KDVVQIQTVLLSLGF | 15 | 0.066 |
| MY924Fe3.p1t1 | | 1331 | 100.0024 | SQIIIILPSILENIL | 15 | 0.092 |
| MY924Fe3.p1t1 | | 1526 | 100.0025 | MHSVKEMIVYLIQNN | 15 | 0.262 |
| MY924Fe3.p1t1 | | 1703 | 100.0026 | TINLINELMKRQHDK | 15 | 0.192 |
| MY924Fe3.p1t1 | | 1746 | 100.0027 | REMLLKMKSMSRNQR | 15 | 0.130 |
| MY924Fe3.p1t1 | | 1878 | 100.0028 | RSIIFAGHTIELNSL | 15 | 0.248 |
| MY924Fe3.p1t1 | | 1890 | 100.0029 | NSLMFKQTSGRAGRR | 15 | 0.061 |
| MY924Fe3.p1t1 | | 2201 | 100.0030 | NLIITYLLIKKVLHN | 15 | 0.162 |
| MP03001 | MAL3P2.11 | 1 | 100.0031 | MRKLAILSVSSFLFV | 15 | 2.786 |
| MP03001 | MAL3P2.11 | 36 | 100.0032 | ELNYDNAGTNLYNEL | 15 | 1.040 |
| MP03001 | MAL3P2.11 | 342 | 100.0033 | QVRIKPGSANKPKDE | 15 | 0.460 |
| 1369.t00001 | Chromosome11 | 28 | 100.0034 | LLKIWKNYMKIMNHL | 15 | 0.328 |
| 1369.t00001 | Chromosome11 | 43 | 100.0035 | MTLYQIQVMKRNQKQ | 15 | 0.056 |
| 1369.t00001 | Chromosome11 | 57 | 100.0036 | QKQVQMMIMIKFMGV | 15 | 0.016 |
| 1369.t00001 | Chromosome11 | 63 | 100.0037 | MIMIKFMGVIYIMII | 15 | 0.545 |
| 1369.t00001 | Chromosome11 | 70 | 100.0038 | GVIYIMIISKKMMRK | 15 | 0.076 |
| 1369.t00001 | Chromosome11 | 285 | 100.0039 | LYYLFNQHIKKELYH | 15 | 0.742 |
| 1369.t00001 | Chromosome11 | 299 | 100.0040 | HFNMLKNKMQSSFFM | 15 | 0.560 |
| 1369.t00001 | Chromosome11 | 353 | 100.0041 | XDIYQKLYIKQEEQK | 15 | 0.807 |
| 1369.t00001 | Chromosome11 | 366 | 100.0042 | QKKYIYNLIMNTQNK | 15 | 0.167 |
| 1369.t00001 | Chromosome11 | 381 | 100.0043 | YEALIKLLPFSKRIR | 15 | 0.701 |
| 699.t00001 | Chromosome11 | 565 | 100.0044 | NIHFAVLFLTLTVYP | 15 | 0.347 |
| 699.t00001 | Chromosome11 | 569 | 100.0045 | AVLFLTLTVYPINNF | 15 | 0.255 |
| 699.t00001 | Chromosome11 | 623 | 100.0046 | KLLYKMNYLKQDINN | 15 | 0.545 |
| 699.t00001 | Chromosome11 | 744 | 100.0047 | KKEFKNSLILLNLYN | 15 | 0.576 |
| 699.t00001 | Chromosome11 | 773 | 100.0048 | YLSFKILNTLLYNHI | 15 | 0.234 |
| 699.t00001 | Chromosome11 | 866 | 100.0049 | IYILINHVIIPSLFY | 15 | 0.400 |
| 699.t00001 | Chromosome11 | 875 | 100.0050 | IPSLFYLMNFLKFI | 15 | 0.347 |
| 699.t00001 | Chromosome11 | 929 | 100.0051 | KYLIILLYIFKLIEY | 15 | 0.701 |
| 699.t00001 | Chromosome11 | 978 | 100.0052 | FIFMQNNQTKLAEMK | 15 | 0.039 |
| 699.t00001 | Chromosome11 | 1032 | 100.0053 | LFIYIWLHLIIIFIF | 15 | 0.423 |
| mal_4T2c4.p1t1 | | 15 | 100.0054 | ILLIRPMLVKLRPKL | 15 | 0.221 |

TABLE 6-continued

Pf-derived 15mer peptides with nonamer core sequences scoring DR1 PIC <4 nM

| Antigen | Addn Source info | Position | Peptide No. | Sequence | AA | DR1 PIC |
|---|---|---|---|---|---|---|
| mal_4T2c4.p1t1 | | 19 | 100.0055 | RPMLVKLRPKLVKLR | 15 | 0.083 |
| mal_4T2c4.p1t1 | | 26 | 100.0056 | RPKLVKLRPMLVKLG | 15 | 0.010 |
| mal_4T2c4.p1t1 | | 33 | 100.0057 | RPMLVKLGPILVKLR | 15 | 0.004 |
| mal_4T2c4.p1t1 | | 40 | 100.0058 | GPILVKLRPMLVKLR | 15 | 0.010 |
| mal_4T2c4.p1t1 | | 47 | 100.0059 | RPMLVKLRPMLAKLR | 15 | 0.016 |
| mal_4T2c4.p1t1 | | 54 | 100.0060 | RPMLAKLRPMLAKLR | 15 | 0.027 |
| mal_4T2c4.p1t1 | | 61 | 100.0061 | RPMLAKLRPMLVKLR | 15 | 0.137 |
| mal_4T2c4.p1t1 | | 68 | 100.0062 | RPKLVKLRPKLVKLR | 15 | 0.083 |
| mal_4T2c4.p1t1 | | 75 | 100.0063 | RPKLVKLRPISVNAK | 15 | 0.076 |
| M13Hg2.q1t3 | | 89 | 100.0064 | ILEMKPNILLSRFIF | 15 | 0.742 |
| M13Hg2.q1t3 | | 122 | 100.0065 | NISINNAFSLPVNIY | 15 | 0.663 |
| M13Hg2.q1t3 | | 163 | 100.0066 | YFNIIQQKIQSNFLL | 15 | 0.487 |
| M13Hg2.q1t3 | | 281 | 100.0067 | ISTFIKNNINHQENN | 15 | 0.682 |
| M13Hg2.q1t3 | | 442 | 100.0068 | LKNMDGNILIKDFIQ | 15 | 0.378 |
| M13Hg2.q1t3 | | 488 | 100.0069 | IEFYNINMAKKVMNN | 15 | 0.285 |
| M13Hg2.q1t3 | | 492 | 100.0070 | NINMAKKVMNNMEKN | 15 | 0.145 |
| M13Hg2.q1t3 | | 558 | 100.0071 | FVNYFEAVVHMNIHC | 15 | 0.831 |
| M13Hg2.q1t3 | | 691 | 100.0072 | NNNIINGHMLEQKLS | 15 | 0.123 |
| M13Hg2.q1t3 | | 869 | 100.0073 | NNDMKKGYTNVSNNS | 15 | 0.162 |
| Mal_5L10c4.q1t6 | | 154 | 100.0074 | NNEFFGYPLQFVCET | 15 | 0.255 |
| Mal_5L10c4.q1t6 | | 336 | 100.0075 | FFIIKNVGVHKITYY | 15 | 0.388 |
| Mal_5L10c4.q1t6 | | 1090 | 100.0076 | KIEYISMLSPTINEI | 15 | 0.113 |
| Mal_5L10c4.q1t6 | | 1101 | 100.0077 | INEIKTLNTILTIPL | 15 | 0.018 |
| Mal_5L10c4.q1t6 | | 1107 | 100.0078 | LNTILTIPLIKMNEY | 15 | 0.042 |
| Mal_5L10c4.q1t6 | | 1264 | 100.0079 | HKLFINKLMTSNIRK | 15 | 0.203 |
| Mal_5L10c4.q1t6 | | 1289 | 100.0080 | QNRFRNQLLYLTKIA | 15 | 0.050 |
| Mal_5L10c4.q1t6 | | 1609 | 100.0081 | IKKIKTPLILPIDPN | 15 | 0.035 |
| Mal_5L10c4.q1t6 | | 1888 | 100.0082 | QDHLVIQIIYVMDNI | 15 | 0.133 |
| Mal_5L10c4.q1t6 | | 2031 | 100.0083 | IEAMGGAHSIGYEQF | 15 | 0.068 |
| 571.t00003 | Chromosome11 | 33 | 100.0084 | FDDFKINYSYKTKNH | 15 | 0.182 |
| 571.t00003 | Chromosome11 | 462 | 100.0085 | ITDLNNMNVNQSNMK | 15 | 0.500 |
| 571.t00003 | Chromosome11 | 960 | 100.0086 | TNNFNNNVMMLMNTS | 15 | 0.007 |
| 571.t00003 | Chromosome11 | 1124 | 100.0087 | EQNVAQNVAQNVAQN | 15 | 0.460 |
| 571.t00003 | Chromosome11 | 1128 | 100.0088 | AQNVAQNVAQNVEQN | 15 | 0.460 |
| 571.t00003 | Chromosome11 | 1550 | 100.0089 | SNKFMTPTTLKEKYQ | 15 | 0.255 |
| 571.t00003 | Chromosome11 | 1941 | 100.0090 | NIHMINDVATKLNQH | 15 | 0.285 |
| 571.t00003 | Chromosome11 | 2112 | 100.0091 | HIHMMNQQIQKETNT | 15 | 0.576 |
| 571.t00003 | Chromosome11 | 2255 | 100.0092 | NNVFQQPLSYSNGSE | 15 | 0.347 |
| 571.t00003 | Chromosome11 | 2738 | 100.0093 | NNTINMNGMNKTESI | 15 | 0.198 |
| MP03072 | PFC0450w | 5 | 100.0094 | LNILILIDAASVAFL | 15 | 0.722 |
| MP03072 | PFC0450w | 8 | 100.0095 | LILIDAASVAFLLIT | 15 | 1.340 |
| MP03072 | PFC0450w | 17 | 100.0096 | AFLLITFLMINLNEE | 15 | 1.197 |
| MP03072 | PFC0450w | 44 | 100.0097 | KKALVVAIILYVIFL | 15 | 0.302 |
| MP03072 | PFC0450w | 48 | 100.0098 | VVAIILYVIFLVLLF | 15 | 0.609 |
| MP03072 | PFC0450w | 52 | 100.0099 | ILYVIFLVLLFIYKA | 15 | 0.831 |
| MP03072 | PFC0450w | 55 | 100.0100 | VIFLVLLFIYKAYKN | 15 | 0.956 |
| MP03072 | PFC0450w | 58 | 100.0101 | LVLLFIYKAYKNKRK | 15 | 4.016 |
| MP03072 | PFC0450w | 76 | 100.0102 | NFFMKKRNAPKYVQL | 15 | 0.593 |
| MP03072 | PFC0450w | 85 | 100.0103 | PKYVQLASTYLSASD | 15 | 2.865 |
| 45.t00001 | Chromosome14 | 2 | 100.0104 | ENEYATGAVRPFQAA | 15 | 0.722 |
| 45.t00001 | Chromosome14 | 27 | 100.0105 | NYELSKKAVIFTPIY | 15 | 1.197 |
| 45.t00001 | Chromosome14 | 108 | 100.0106 | QKILIKIPVTKNIIT | 15 | 0.085 |
| 45.t00001 | Chromosome14 | 156 | 100.0107 | KCLVISQVSNSDSYK | 15 | 2.044 |
| 45.t00001 | Chromosome14 | 202 | 100.0108 | SKIMKLPKLPISNGK | 15 | 0.742 |
| 45.t00001 | Chromosome14 | 220 | 100.0109 | FIHFFTWGTMFVPKY | 15 | 0.026 |
| 45.t00001 | Chromosome14 | 242 | 100.0110 | LCNFKKNIIALLIIP | 15 | 0.203 |
| 45.t00001 | Chromosome14 | 246 | 100.0111 | KKNIIALLIIPPKIH | 15 | 0.010 |
| 45.t00001 | Chromosome14 | 251 | 100.0112 | ALLIIPPKIHISIEL | 15 | 1.267 |
| 45.t00001 | Chromosome14 | 274 | 100.0113 | SMEYKKDFLITARKP | 15 | 1.826 |
| MP03137 | PFC0700c | 7 | 100.0114 | KSKFNILSSPLFNNF | 15 | 1.987 |
| MP03137 | PFC0700c | 173 | 100.0115 | FKKLKNHVLFLQMMN | 15 | 0.785 |
| MP03137 | PFC0700c | 177 | 100.0116 | KNHVLFLQMMNVNLQ | 15 | 0.095 |
| MP03137 | PFC0700c | 180 | 100.0117 | VLFLQMMNVNLQKQL | 15 | 0.068 |
| MP03137 | PFC0700c | 187 | 100.0118 | NVNLQKQLLTNHLIN | 15 | 0.956 |
| MP03137 | PFC0700c | 191 | 100.0119 | QKQLLTNHLINTPKI | 15 | 1.132 |
| MP03137 | PFC0700c | 197 | 100.0120 | NHLINTPKIMPHHII | 15 | 0.576 |
| MP03137 | PFC0700c | 239 | 100.0121 | YILLKKILSSRFNQM | 15 | 1.100 |
| MP03137 | PFC0700c | 250 | 100.0122 | FNQMIFVSSIFISFY | 15 | 2.420 |
| 12.t00018 | Chromosome14 | 36 | 100.0123 | CNILKENNTYKQKKH | 15 | 4.016 |
| 12.t00018 | Chromosome14 | 133 | 100.0124 | TNELKKMDTKKDVHM | 15 | 1.011 |
| 12.t00018 | Chromosome14 | 504 | 100.0125 | EVKFILHMTLLTLYK | 15 | 0.269 |
| 12.t00018 | Chromosome14 | 542 | 100.0126 | KYNFLNIYASLRNEY | 15 | 0.328 |
| 12.t00018 | Chromosome14 | 583 | 100.0127 | TRCFKNSYPKKVWKK | 15 | 0.293 |
| 12.t00018 | Chromosome14 | 612 | 100.0128 | NNLYVSMYIPFIKKF | 15 | 0.411 |
| 12.t00018 | Chromosome14 | 1000 | 100.0129 | EAKFKIERLLKSSYK | 15 | 3.298 |

TABLE 6-continued

Pf-derived 15mer peptides with nonamer core sequences scoring DR1 PIC <4 nM

| Antigen | Addn Source info | Position | Peptide No. | Sequence | AA | DR1 PIC |
|---|---|---|---|---|---|---|
| 12.t00018 | Chromosome14 | 1057 | 100.0130 | KIYILNNNLLIVHLS | 15 | 1.543 |
| 12.t00018 | Chromosome14 | 1184 | 100.0131 | KCSFDKTNPIQQSGK | 15 | 2.044 |
| 12.t00018 | Chromosome14 | 1212 | 100.0132 | TGIFNMPNLVQINNY | 15 | 0.078 |
| mal_BU121g9.q1c1 | | 29 | 100.0133 | EGMLTVAGPRSQTEL | 15 | 3.298 |
| mal_9A57b11.q1t2 | | 3 | 100.0134 | KQNIKYTQIISIDNI | 15 | 2.633 |
| mal_9A57b11.q1t2 | | 18 | 100.0135 | LNKIADPILIGFSSS | 15 | 0.929 |
| mal_9A57b11.q1t2 | | 123 | 100.0136 | NRIYNKLKLHKIIRK | 15 | 1.267 |
| mal_9A57b11.q1t2 | | 194 | 100.0137 | NNEYGILNAQKALSN | 15 | 0.098 |
| mal_9A57b11.q1t2 | | 197 | 100.0138 | YGILNAQKALSNLHK | 15 | 0.141 |
| mal_9A57b11.q1t2 | | 229 | 100.0139 | KIFVKYLPLFLMMEH | 15 | 0.042 |
| mal_9A57b11.q1t2 | | 236 | 100.0140 | PLFLMMEHSFLNCHK | 15 | 3.031 |
| mal_BL50e8.p1ca_5 | | 1 | 100.0141 | MEGFVALLSFLVVLV | 15 | 0.004 |
| mal_BL50e8.p1ca_5 | | 100 | 100.0142 | VDGMKIGHPISVALG | 15 | 0.010 |
| mal_BL50e8.p1ca_5 | | 151 | 100.0143 | GSTYMTPSAIKIKVP | 15 | 0.057 |
| mal_BL50e8.p1ca_5 | | 189 | 100.0144 | NNLFIYNWVLQTSSP | 15 | 0.560 |
| mal_BL50e8.p1ca_5 | | 347 | 100.0145 | EKILIRALLSLDFSL | 15 | 0.722 |
| mal_BL50e8.p1ca_5 | | 437 | 100.0146 | HPVYPTAPAVAFPAG | 15 | 0.187 |
| mal_BL50e8.p1ca_5 | | 585 | 100.0147 | EVYYFPGKVTRVRAK | 15 | 0.357 |
| mal_BL50e8.p1ca_5 | | 606 | 100.0148 | EDKLVKIYISLLSSD | 15 | 0.423 |
| mal_BL50e8.p1ca_5 | | 685 | 100.0149 | IERYVGLGSFHFYLY | 15 | 0.423 |
| mal_BL50e8.p1ca_5 | | 816 | 100.0150 | CFQVLNPVTIPKYCI | 15 | 0.285 |
| M13S8h6.p1t_3 | | 68 | 100.0151 | FMSFKILEALLVCIS | 15 | 0.006 |
| M13S8h6.p1t_3 | | 127 | 100.0152 | KQIVIFLISLLSFTL | 15 | 0.473 |
| M13S8h6.p1t_3 | | 169 | 100.0153 | AKQIEILHTMLPNFL | 15 | 0.095 |
| M13S8h6.p1t_3 | | 218 | 100.0154 | IDDFQNMVSTLQPHV | 15 | 0.034 |
| M13S8h6.p1t_3 | | 285 | 100.0155 | KCAIKLAIAQLSAKY | 15 | 0.130 |
| M13S8h6.p1t_3 | | 343 | 100.0156 | IGSVKPQYALFGDTV | 15 | 0.228 |
| M13S8h6.p1t_3 | | 871 | 100.0157 | KIYIKKKRLLQMNNY | 15 | 0.411 |
| M13S8h6.p1t_3 | | 1350 | 100.0158 | KKLLKKLTSNLQLNK | 15 | 0.076 |
| M13S8h6.p1t_3 | | 1602 | 100.0159 | QDFLTKILPRQVLEE | 15 | 0.241 |
| M13S8h6.p1t_3 | | 1754 | 100.0160 | MWGLDVLIANKIESN | 15 | 0.423 |
| 585.t00002 | Chromosome11 | 5 | 100.0161 | FFILFYFYVMSTYTF | 15 | 0.500 |
| 585.t00002 | Chromosome11 | 16 | 100.0162 | TYTFCFLPVLQTQLG | 15 | 0.515 |
| 585.t00002 | Chromosome11 | 349 | 100.0163 | KKKYKNKKMPKTIDG | 15 | 0.473 |
| 585.t00002 | Chromosome11 | 487 | 100.0164 | GRAIIPLFLILNTYK | 15 | 0.269 |
| 585.t00002 | Chromosome11 | 562 | 100.0165 | KIIFKRNPLFLTFLS | 15 | 0.367 |
| 585.t00002 | Chromosome11 | 643 | 100.0166 | WLFFFDLVVLSPFSL | 15 | 0.500 |
| 585.t00002 | Chromosome11 | 774 | 100.0167 | KNIIKGKNMMTRGGG | 15 | 0.106 |
| 585.t00002 | Chromosome11 | 796 | 100.0168 | KMFIKGDTVMKANII | 15 | 0.038 |
| 585.t00002 | Chromosome11 | 1093 | 100.0169 | VGSYKLMISQEAEFE | 15 | 0.487 |
| 585.t00002 | Chromosome11 | 1344 | 100.0170 | LNRFITLITWTQLHVS | 15 | 0.095 |
| 1223.t00015 | mal_9A21f9.q1t_4 | 1070 | 100.0171 | RTKYETLVTIHVHQR | 15 | 0.087 |
| 1223.t00015 | mal_9A21f9.q1t_4 | 1162 | 100.0172 | GLCYGGAPAGPAGTG | 15 | 0.059 |
| 1223.t00015 | mal_9A21f9.q1t_4 | 1654 | 100.0173 | DSILILQTINLLNSQ | 15 | 0.177 |
| 1223.t00015 | mal_9A21f9.q1t_4 | 2461 | 100.0174 | KHLIINRVMQTPNG | 15 | 0.043 |
| 1223.t00015 | mal_9A21f9.q1t_4 | 2779 | 100.0175 | IDLYKQMYVKKYDEI | 15 | 0.158 |
| 1223.t00015 | mal_9A21f9.q1t_4 | 2878 | 100.0176 | DKDLKAALPYLHEAE | 15 | 0.103 |
| 1223.t00015 | mal_9A21f9.q1t_4 | 2985 | 100.0177 | TIELLKPYIQSTFFK | 15 | 0.145 |
| 1223.t00015 | mal_9A21f9.q1t_4 | 2995 | 100.0178 | STFFKTQIAKKASVA | 15 | 0.002 |
| 1223.t00015 | mal_9A21f9.q1t_4 | 3014 | 100.0179 | CKWVGAMAMYNQASK | 15 | 0.145 |
| 1223.t00015 | mal_9A21f9.q1t_4 | 3019 | 100.0180 | AMAMYNQASKIVKPK | 15 | 0.116 |
| 599.t00001 | Chromosome11 | 12 | 100.0181 | INFFILLTLVFQKYS | 15 | 0.177 |
| 599.t00001 | Chromosome11 | 364 | 100.0182 | NNNLGIPTLIKKEVH | 15 | 0.234 |
| 599.t00001 | Chromosome11 | 519 | 100.0183 | EEDIKNAYLPENKNF | 15 | 0.435 |
| 599.t00001 | Chromosome11 | 1074 | 100.0184 | INVFIKEISKLFDHD | 15 | 0.529 |
| 599.t00001 | Chromosome11 | 1414 | 100.0185 | DKSLKIMYSLFNKYT | 15 | 0.098 |
| 599.t00001 | Chromosome11 | 1463 | 100.0186 | VVIFIYGNIISDLK | 15 | 0.645 |
| 599.t00001 | Chromosome11 | 1621 | 100.0187 | CESFISKVTNKVIKK | 15 | 0.215 |
| 599.t00001 | Chromosome11 | 1740 | 100.0188 | ICTFVKYITFQLLNI | 15 | 0.854 |
| 599.t00001 | Chromosome11 | 1767 | 100.0189 | KEHYIMNNTIFTFNQ | 15 | 0.141 |
| 599.t00001 | Chromosome11 | 1892 | 100.0190 | KKKYKYIPSNGTTQS | 15 | 0.500 |
| M1045c5.p1c.C_6 | | 53 | 100.0191 | EKSLGILGSIQNAYL | 15 | 0.085 |
| M1045c5.p1c.C_6 | | 59 | 100.0192 | LGSIQNAYLYKSIFK | 15 | 0.388 |
| M1045c5.p1c.C_6 | | 588 | 100.0193 | SCIMNNMIVTKESNE | 15 | 0.473 |
| M1045c5.p1c.C_6 | | 1040 | 100.0194 | KDFMKNNTTLFSHFN | 15 | 0.241 |
| M1045c5.p1c.C_6 | | 1136 | 100.0195 | MLYLIRNILMSIEDY | 15 | 0.435 |
| M1045c5.p1c.C_6 | | 1229 | 100.0196 | KKKYIKLNIFKNIIL | 15 | 0.378 |
| M1045c5.p1c.C_6 | | 1350 | 100.0197 | RWDLVMNMMIGIRIS | 15 | 0.054 |
| M1045c5.p1c.C_6 | | 1380 | 100.0198 | HKDVIQLPTSNAQHK | 15 | 0.167 |
| M1045c5.p1c.C_6 | | 1393 | 100.0199 | HKVIFKNYAPIIFKN | 15 | 0.262 |
| M1045c5.p1c.C_6 | | 1430 | 100.0200 | SNMVLGNLSTLSELL | 15 | 0.423 |
| PIR2 | T28161 | 46 | 100.0201 | AKFYNGGEIMQPNSK | 15 | 0.153 |
| PIR2 | T28161 | 319 | 100.0202 | KRNLKLQNAIKNCRG | 15 | 0.043 |
| PIR2 | T28161 | 1072 | 100.0203 | HVKIIKNLLIHGKEQ | 15 | 0.302 |
| PIR2 | T28161 | 1093 | 100.0204 | KYKLLYLQAQTTAAN | 15 | 0.141 |

TABLE 6-continued

Pf-derived 15mer peptides with nonamer core sequences scoring DR1 PIC <4 nM

| Antigen | Addn Source info | Position | Peptide No. | Sequence | AA | DR1 PIC |
|---|---|---|---|---|---|---|
| PIR2 | T28161 | 1096 | 100.0205 | LLYLQAQTTAANGGP | 15 | 0.047 |
| PIR2 | T28161 | 1589 | 100.0206 | SPKIVVPAPKPTTTF | 15 | 0.119 |
| PIR2 | T28161 | 1951 | 100.0207 | FVDLIRQIAATIDKG | 15 | 0.047 |
| PIR2 | T28161 | 2065 | 100.0208 | QERLVKNPLVQPTLK | 15 | 0.028 |
| PIR2 | T28161 | 2129 | 100.0209 | HPAVIPALVTSTLAW | 15 | 0.072 |
| PIR2 | T28161 | 2419 | 100.0210 | NELFGTNHVKQTSIH | 15 | 0.098 |
| 55.t00004 | Chromosome14 | 81 | 100.0211 | NNEFVVAQLYELNNY | 15 | 1.340 |
| 55.t00004 | Chromosome14 | 117 | 100.0212 | DNNMKKYLIQKCGKK | 15 | 1.776 |
| 55.t00004 | Chromosome14 | 218 | 100.0213 | SCSIIKYELRKTSIC | 15 | 1.878 |
| 55.t00004 | Chromosome14 | 385 | 100.0214 | RNHMDKPPPHNINNN | 15 | 0.228 |
| 55.t00004 | Chromosome14 | 613 | 100.0215 | NNNLIFQNSRFMDHT | 15 | 0.423 |
| 55.t00004 | Chromosome14 | 754 | 100.0216 | THDIIKNVSNNMKRF | 15 | 0.357 |
| 55.t00004 | Chromosome14 | 904 | 100.0217 | FKNVDMLNIYKINKD | 15 | 1.987 |
| 55.t00004 | Chromosome14 | 1136 | 100.0218 | MKDVINLYTYVVNKK | 15 | 0.092 |
| 55.t00004 | Chromosome14 | 1364 | 100.0219 | GMYILPQYVTRECIN | 15 | 1.500 |
| 55.t00004 | Chromosome14 | 1510 | 100.0220 | GDDVIYEETKKTDNI | 15 | 1.587 |
| 13.t00011 | Chromosome14 | 16 | 100.0221 | FKSLKNNNMLESTGI | 15 | 1.587 |
| 13.t00011 | Chromosome14 | 49 | 100.0222 | FLDYVKGKMMDVYKE | 15 | 0.126 |
| 13.t00011 | Chromosome14 | 84 | 100.0223 | TYNYLTPTLKVKRFR | 15 | 3.589 |
| 37.t00002 | Chromosome14 | 50 | 100.0224 | NDLIDQNIVYLNVCN | 15 | 2.560 |
| 674.t00001 | Chromosome11 | 30 | 100.0225 | LKKLKKILLNLDVLI | 15 | 0.742 |
| 674.t00001 | Chromosome11 | 54 | 100.0226 | NENFDMELLNNVNDR | 15 | 1.378 |
| 674.t00001 | Chromosome11 | 124 | 100.0227 | NCPIKNEVTTLIQKI | 15 | 0.367 |
| 674.t00001 | Chromosome11 | 296 | 100.0228 | EKNMTSQKSITSEKN | 15 | 0.854 |
| 674.t00001 | Chromosome11 | 577 | 100.0229 | NSNFKEQHLLFCNNL | 15 | 1.418 |
| 674.t00001 | Chromosome11 | 752 | 100.0230 | NNNIKTHIANFNIIH | 15 | 1.040 |
| 674.t00001 | Chromosome11 | 986 | 100.0231 | NNLYKTYEMIQGDND | 15 | 0.956 |
| 674.t00001 | Chromosome11 | 1093 | 100.0232 | NDNYINNNIYLNKAN | 15 | 1.340 |
| 674.t00001 | Chromosome11 | 1353 | 100.0233 | FLQYRIPHMNNNGNI | 15 | 0.983 |
| 674.t00001 | Chromosome11 | 1432 | 100.0234 | VDIFCKIHALKNENK | 15 | 0.854 |

SEQUENCE LISTING (1161 sequences)

SEQ ID NO: 1 - protein, 1904 aa, Plasmodium falciparum
MSPSKTMDTFYKKKRNVLTLINDEQDLYIYKDIYNNCENDIYSLYLNIINQYKNCLDGEKKLFLNKCIKNGNVKYIEKVVKQIIEKKNVYNDIDDKSIKKSIDLLIYPCVYEINKNEFYYTTSCCSGRIVIFKEVHINNKNDNQKKIFKNSTTSQEKKEENISHHLSNINLLNVHEKDELFLSHFKKNFILQNNEEKYTYCSDHDISSFFDVSKKKTNKWEDIYEEKNLKENILYINKEHKKKKVRKKKKIHKKNVHILYSSHSHQHLKYDIKVIKDILKKELFQNYFDVNQRNDYKNISFDFMGTKKYSLQNEVNLNSSIITMSDKEGMKKKEKNNKVINILNNQNKRNIFIKFEPFIIHVKCTTFLSALKLLKIAQYAGLKQSGILNFNKHVTVAIRGSMRLEHLLGDIHPTLQQTNLMEIIHICNNKLSKNLSQLVHFYKCFKQFKEHEHTYQFVSINREMLSSLENNLSSNTKQKKKSNKKNTLHVKDNLQDNKKIAHHMKKKKKEINHLYLTCSGKKNIPNGNRSIAEQDKTECKLKDEIIYENTENHINIIKKEKNIIDLNKYNIQLNEEGYIINENKNDKFIGWKILGNNNMNVQNFFVWGHDMFMQENKIYMFGGFSKGVRNNKLKIYDIINKKHFIYDTELPSLVFHNFVQLDDKFAFIFGGRQNPKNCTNMVWVYNIKENFWIKARRTSTLVRKNKNVLFLEKMEKNMEVKMDRMKYHMGKKYNNDDNNSDNNNDNNNDNNNNNFLCNDENIFYFNNEEEPCPRYRHASVFVRRYIKKSKSIYIFYTYGGVNEKNEILNDIWEGKIILNLEDKGIAHIEWNKKNCSQKTEACRINNHSMIYNKKKNFIYIVGGYQDNDKDNYTQYNEYNNNNNNNNKDNSVNSDDMIGMPNLSSTVVCKKMEYLYTYDIKKDNFFYTKCLGDDNMELKAYPSDRFSHSTCLINHNFFMLVGGINIHRTLNDVWLFHIKTNKWNYLGTFTFQNMYVRSKVVSENNCVYIIGGGCTVFTFGSFFDVPIWSNFSGIMKSIQHKELKNVLIFSEDREVKEGQATYNNEIKKNCGNNNDNNNNNNNNNNNNNKCSNNYNILVDKVARNEHLEKYNLCHNMLIEHKDVIKKEILVFEKKKKKKKKKDEKGDDIMDVEKKNELPHIIDEEKKGTDRDVEKSSFCLDEKSIKIGLYIIIKNKHFVKQIKVYLENKKMFDNSLKIYNPKGNQKNEENEKNEENEKNEENEKNEENEKNEENEKNEDYNKIMGEEKKFYVPIKKKLDDDILKNDEYFKTVLLDKIERCNDGNILYYEKVICEIYNGKYQDNIKSQNSNTFLKKKLRILFHKFLNKKVKNYLNSSEKKMVLQGYRKYEIIGNILIFHYKYFECIMKLYKVYEGKLKKYKKEINEMIERRRLYRDYSYIIKNKKKHNKLVSCFLMNDIYEYKYYVKEVKKFWLAIKDIFNNKDIFNNKEIILNTNILSLKKKKKEKKKKKKNNNNNKFYVKVKFNKKGITNKINILLYRRRKNLFDENFCRNIMKRNKNCEIIKKKRKIKCVALYEKVHGKLRQNKIHIVCGKNLKTVHIENKIKYKLDLTKCMFSSGNGTEKERMKNMYIVSNNDDNINNKDKNKNNNNNNNNNDNNNLLDEKRDRVKENVVDLFCGVGYFTLPLLKCIEAQNKINNYFACDINPDSLKLLRESIKLNNINKKNIYIIKQNSFMLSKNVQMVRKCHRIILGLLPHSQPAWKNAFFLLDNKYGGILHIHGIGQHIFDEQVCFSSINTYDYILKKKDVNISSINKLTKLQMVEEYVSNVEDSNYVEEIKKNKDHFHNKYINHYNSNYNKKLYLGNNIPHNLSFAQYTLIEIFKIALYDNLKNNIFWNIAISHVERVKSYAPRMYHYVVDIKCDPLIF

SEQ ID NO: 2 - protein, 208 aa, Plasmodium falciparum
NVLRLFVCFLIFHFFLFLLYILFLVKMNALRRLPVICSFLVFLVFSNVLCFRGNNGHNSSSSLYNGSQFIEQLNNSFTSAFLESQSMNKIGDDLAETISNELVSVLQKNSPTFLESSFDIKSEVKKHAKSMLKELIKVGLPSFENLVAENVKPPKVDPATYGIIVPVLTSLFNKVETAVGAKVSDEIWNYNSPDVSESEESLSDDFFD

SEQ ID NO: 3 - protein, 2404 aa, Plasmodium falciparum
MDLMNDEYDIDDPKERNIIKGDYDDDNMGNNGFSIINSYKDIDVNDVNDLESIVKNDEISVDRKLEYFYSKLNSNIFDIFRIVADYENIYIISGEGLIIYVCMLLSKFYSFKNEEDKNILSFDNSLNMISVVYYIEKILSDICACNSNFHIIFFNVFNIFFEKKKNKLFQNYNLLRNAFIIHCKKNLIPYFIFNNWYNDENYNIYLIKYKPLFMFVEDSSSFLYAFNKYYVSNVNTDNKENNVNINQEKKNIFVDNDKNINGDHYDDDVENIEKKKNYKEYIYKKNIYDSYNNDIREMSLCFYFLLLNNILRDIKCVFFFNLESEKNTINAFSINYTGVNFEAMKQLNDKASLLFDNVYYEKKENSNREEINDKVSKQGCNLNDSDSSNVLYINIQNIKDYDILYKEDNKNYNDVENQMLNRFMNNVKEENVDLKNMALHIFFYKIIDETEHVVHMNKKEYKYFHLVMKILFLHNYLLEKMNMLNLCIDNLNEFNDIYKIIKEAVHTHICDYLDVYNFLLKLLQRYEYSNILKSIRNSDLLNFFNSSIIQNLINFLCQKISQDVFIIEYDDMPFEDKDNFEMSYKNILKEKYECLFPIDLSFLRDDINMLCKRGDATNDDNEDNIINSNDDRLEVVSKKKEVNDDNKNIVTINLIRIKNELVETFFYLNDISHNNNNNNNCEVDNMIEEKKREMVLKIIFINKCLEYDNNFFELTGMLHISERENVVDIFNSYMKLSSLSRNLPFANQKDDKYKLRRQQKDERRKAIIAKYFYISSLHHPIVISENHPWIKYYSYNIEKLYDYLRNEEKKKGITQRMKVLFDSSSEREDDEKDGDHEIVKISNISSDLKNKNKKNKRLSDSKHTNEKTIMKKKLCTNIKLKKNNDIFEILDDHFDEDSDRPEDMNSINEHGNKKEDSSNKKGKNETKVGKKGSKNSNATTLSRKDEILKKKELSNEKKTYEVDLERYNNLEQKIVKLASDDSYAEMNVWSLDIISGYNRLVDVYNFNNITNLIKSVDLQIKISMKVLNSMFHIIMYTKLKNIKTGKQKSDAIRSIILIYRLTNDIFNKFKEHLSEKDVVQIQTVLLSLGFQNSSYNLFEEYVKLKKDTYNASSNDGKDEAGNKVDECVSSGKKGKENKKEESNSKKKISKGKKENNDTKDVNLKKASKKGDVNNSNSIIKSLDDIYKYKLESVKTYSELKIDENKEHEFQLYYMYYLLDRTTGNIKDSRVLFTLDTWQYNILNLVDRRKSILVSCPTSSGKTFICYYVMDKVLRLNNDSVVIYVAPNDTLALQIYHEVNGRFSTKGYSKYGGNKLCSYMTDKYAEEKALDSQIIIILPSILENILLSYYALNDMNENMNVSKFISKIEYIIFDEIHCIGDKEFYGSQIENIIHLINCPFLALSATIGNINCFYSWLQNVLLKKGRSINDLHLIKFYERFSDLILYVYTNKNLHHLNPLTCFNFRDILYKGINKDFYCNPREIYEIIIILFELARKKNFYHLVEFLEPSFYFQYTRCINKKKFIYYMHSVKEMIVYLIQNNYINNLEYDMIIHILLSNYMKNSFYIKDENEEDIERKNKINDNNNNNINCDNTKNNVDDEDVKTNDKVIKKSDKVVVKNLYKSTIRDNVPKEKLFQELYKRVNFDEKYISNRTNDLVKYTEMVNMEQEYLDSDKLIELLKKLEDINFLPCIVFNFERKELEDMTINLINELMKRQHDKYYGDEERAFNTKMENKMRREKYENMLKQREMLLKMKSMSRNQRLEQNIDKEYLDMLIDDEIPEPPLDVSEEYDKDFYFCNQKVYCNYVTEIEDLIKDAQKAIEGRKYKSILIEGLRRGIGLHYEVLPYKFTIIVESLFRLGFVKIIFSNKNLSLGINIPCRSIIFAGHTIELNSLMFKQTSGRAGRRGFDLYGNIIIWNINFKNLKRLITSPLQTLSGTYSVNFTNICRSMLLYNSLKRIRENEEGSLKNKVIVNKPNKKKKKDETLSVAEKEEIFEKNRAINVNYFSRINGILSLFFNSLYYINSFQESEQNYNNMNNVVVSGDNVCSLTTNCQNGNENGKGHINNISTCTTTSTSSVNNMENNNNSNMNGCGDKKSEGSERHEMIQHILHEFNEYKENDKLSKFINREYEYNELLVELLTNRKMKNNKLQEEKEINELCFMTRAHFHIFLNVLIEMEALDEEGNIINLTELSIFLKKEYDNNLIITYLLIKKVLHNIIGDNTFLSSSVVISLNRIIDSITFEKNYYRSIIVDDSTRGQFILLFILSHFINKRKENKIALTKALINSQYEENKSKLELFSSYYFPLLHALPTSIQKHIDHIENILLKYLVNYCLVVLIKLNLLNKKKANLLPYTKLYIFEQHPCVSLKDIFPKKENADYFKFYKSKVIIIYIYIYIKIYVCIYYLT

SEQ ID NO: 4 - protein, 396 aa, Plasmodium falciparum
MRKLAILSVSSFLFVEALFQEYQCYGSSSNTRVLNELNYDNAGTNLYNELEMNYYGKQENWYSLKKNSRSLGENDDGNNEDNEKLRKPKHKKLKQPADGNPDPNANPNVDPNANPNVDPNANPNVDPNANPNANPNANPNANPNANPNANPNANPNANPNANPNANPNANPNANPNANPNANPNANPNANPNANPNVDPNANPNANPNANPNANPNANPNANPNANPNANPNANPNANPNANPNANPNANPNANPNANPNANPNANPNANPNKNNQGNGQGHNMPNDPNRNVDENANANSAVKNNNNEEPSDKHIKEYLNKIQNSLSTEWSPCSVTCGNGIQVRIKPGSANKPKDELDYANDIEKKICKMEKCSSVFNVVNSSIGLIMVLSFLFLN

SEQ ID NO: 5 - protein, 400 aa, Plasmodium falciparum
  MISC_FEATURE (85)..(85): Unknown
  MISC_FEATURE (123)..(123): Unknown
  MISC_FEATURE (353)..(353): Unknown
MKILIKLKKIYKIIIWIKTMNNYMIKKLLKIWKNYMKIMNHLMTLYQIQVMKRNQKQKQVQMMIMIKFMGVIYIMIISKKMMRKXKKKKKKSTRTQAKSLDTKLIDKDLMNTKQIEKELLDTXLIENEFIHNKLFDTDMIEKELMDTELIENELMNYELFDKDTFFKENYFNDEQQRTDESNVDQQNDMYVIKNNKDSMKGDYYIKKKKKKLVTDNTKDLNKCSSYKSSKRDKFFENIKRENHMDDQHNENIYINIKNNKSTHTYKKKNNHIFHKNVYYNILIVLYYLFNQHIKKELYHFNMLKNKMQSSFFMNRFYITTRYKYLNKKYINFINFIKVLKENHEQKLSEYYDXDIYQKLYIKQEEQKKYIYNLIMNTQNKYEALIKLLPFSKRIRKKSIF

SEQ ID NO: 6 - protein, 1062 aa, Plasmodium falciparum
MKENIFDTKKKNNNRKRNIIRSAKWNNKNSKIELSKKRDSSNKYKSILKYYKNENKTNKFIDKRKKNKWFHKNRKLQKKNIFNLNDDVLFKERHISTNDFIHSDNSLKETDQENLNDNKKKGNKKYNAMLDKIEEKKLWKLKKYEIKEKLRKFDEHFDEIQKNVLGLNGTKGGAKHSMVIENNKNKLNKVIHESKKRQNFEIHASHKGIGAEKGKQNCYDDGDDEHFDDDDDEQLDDGDDEQLDDDDDEQLDDDDDEQLDDDDDEQLDDDDDEQLDDSDDEIYDNQKEYSHDDEMYNDEKNVDKANYPKTTSDSQNELTNYNSYHTDNSDNEEITKLFNKETLRSKKKGSNENISKEKLNELLEKYKIGDNINICNHFINNTEEEKQNIPIYIYIKNKEYDIKDVILLLDDYHFETQQKILYRIYYINMFNKKGTKSIYHFSFFFSLIDYFILNIYKCLKYNIKVCELLGYYKDIIVKYCHEMKAEFYLYISFLLLIVFSKIQRKIKTNIFFKKKKKILQDYVILNEDNANRKIDVYIYRRILKSVDMFSSIFENYNNENIYISNIHFAVLFLTLTVYPINNFIDDNNMSNVVENKILNPQKNLIINNNPFLDINKNNINDEKLLYKMNYLKQDINNINNYNQQKHPIISFIIEILELLFYNHFYTNNANLLNLKDYQKYDWVFNMNTYENYHNIEACLKKLEVYYSFSSFEDVICENNKGGKEFEHNEINNEIVNDLGIFYRKKEFKNSLILLNLYNIIMENTLEYNPSFFYLSFKILNTLLYNHITSIKEGILDKNKIPHVSEKEKQKIQTINNSNNNNNNNNNNNNNNNNISNNMYDKFDLSFIIFKNIFFFLKIYIDNDINIYILINHVIIPSLFYLYMNFLKFIVTNHIKLDFINIINVAKNINIKEGNDFLFEEDKTYELYQKYLIILLYIFKLIEYSQNHDIKPIIHKTTTEGNISFFTPKYANNQNPKDFIFMQNNQTKLAEMKSIKKKMKQQRKFDYNEVIKICTHISYYKYIYIYIYIFIYLFIYIWLHLIIIFIFVDEEGEQLYLGSKSKR

SEQ ID NO: 7 - protein, 104 aa, Plasmodium falciparum
MLVTLRPNLVIIRPILLIRPMLVKLRPKLVKLRPMLVKLGPILVKLRPMLVKLRPMLAKLRPMLAKLRPKLVKLRPKLVKLRPISVNAKPQLVNVRPVLVKIRP

SEQ ID NO: 8 - protein, 954 aa, Plasmodium falciparum
MNHYNNNNSLYNKIEYRKKRSFAKSKEDERNKSEEDLSEDDKNKDYSSASESNFYKYKKRKNNTYEYKDDKDYTSYDNKFRKIRNIDDILEMKPNILLSRFIFIYKLVDNISEDEIDELIRNISINNAFSLPVNIYINKLSFFSIKDELFVKENLEFLKNNSYFNIIQQKIQSNFLLENRINDDQCCIIEFPSDEASGKLFSLYEKDNCIEIKNNISYIFPLFKLKNKGKNVEEKTGSNKVSDWYCSACNFLNFSRRTACHFCKAPKTSDAKLVDKETSTISTFIKNNINHQENNLYLINNKNLYNNMHVDKGTYNHMLSDPLNMQKVYVYNNMEDNYENILNDTYKDANNNISNNNNNNNNNDNDYNNNNNNNNNSKNNNYNNNYNSNYNRGNENNHLKLSNNNIFFSYNPFHKFNEDSQNYENINKEIICDDQNTNMLILKNMDGNILIKDFIQFLNVTFDKNDVSCIYLFNDIKGSSKKKGFCFIEFYNINMAKKVMNNMEKNYYLNFQDNYLKLDYVYEKEKQYFFNCIQMAKLDISKSSATVVKNNIPYFNFFVNYFEAVVHMNIHCYTYFLMWSSQIIILKKGKPELSEFFFDYNSQYYYHPLYQLYFDNNTKYYMSLSKGYYIWEDGLKCLLRVYLDNLGENVYERENYDKKFSLMDASKNKEHEETHQQARINDDHKYDNISNNNIINGHMLEQKLSNYKIEKENEKKNNNENVILNKISSFVEKAKEIALASKKNIEQMNMNDNNLSILEKKNKEIIKKHFTTDSADDEDEENDNDNDNDEHDDDHDNEKEDNDDELNNVSIKNKDNISDINIIEKQSNDDHNNKQRIDNSSYYDYKKNVKLSDNISNNINNNIPYQNNNNDMKKGYTNVSNNSFNNSNIYNNNNEHINNNDEKDVISEQSEKNINICFICLRKFLNEEMLQRHIDVSNLHKKNVEILSDPVLSN

SEQ ID NO: 9 - protein, 2133 aa, Plasmodium falciparum
MKIRYDKCSSTKDLNYFFHLKLGFFVCYKNHNDKYSFKNKILQKNDTILFFKKKKKFMYLRKKKKKKKKKILIQIIQEYNKYNEYFKYNSNLEGNQGFNKKPEKNKNTKGNVYTDHTNQNAKSKIYNYDMNDDSYSNYVNNNNVFRISSFLILNNEFFGYPLQFVCETEGRSRNHEHYPDVHGDNIKYNKCDDNKYNKCDDNKYDKCDDNKYNKCDDNKYDTCDDNKYDTCDDNKYDTCDDNKYNKYDDDKYDTCDDNKYNKYDDDKYNKYDDDKYNKYDDDKYEKSRKKKKLNNLYKTILTKKKRKKMNSNLCVINKIYKYPIKYCELNSKAFVFFIIKNVGVHKITYYSYNKLFSKDGVLNQGIQICKLYHVNKNKKIKQIIFEALKNKITFSYDNNPNNIKKKIYKFLKKNCAYHDLIKLFYFKGHKQREKCNKKLNMEKTFGVHKSSRYNYKTYKKKKKIDMCKNYCDDILDTYNSKYYKGELSGQHKHIKMTGEQKEEHHIKYTHLNFNHGKDETFYKELYKCNYIEKYISSVNYFLLERRRMFNKYKQQELCVNKNEENNKNKNDDDNKNDDDNKNDDDNNKNDDDNKNDDDDNKNDDDNKNDDDDNKNDDDDNNKNNIQCDNHSDNIYMCGTYGNMENYNVPHSTNNTNLQSIKKRIINMNILDNIRCNKTYKYIDKNKFKCFTYYSCKNYNVCKKIIEKYKLYKFLKKKKIEGYMILNFLNFNKELIYYNEHKKDMSTLHDNLFDVISNNQNENVKYNHICNNNKYDWFFNSFDYVGNLEESITCFNNHKKKENMKNIKNIKKKKKKNLFYNEQHNIKNNKNDYHFDKYPSSLYSHLTNKKMVNNTEVNNIKDENSLQMYIINKDVTKNKDGNLLLNSYYNSKLGKSINTCSKEIYKEEHKNVYIYNKKITKMNIKMKTEQKYICVDSKRNTRTYNSKNIRTYNSKNIRTYNSKNIRTYNRKNIRTYNRKNIRTYNRKNIRTYNRKNIRCNNRKKFHLNRNKKKNGCVKKYKLYDERNTLVYKNKIGSNHFFLKEEIGKSTKKLNDIFEHISNYTNRISKNINITNKNRYDDYPFDFLSKDKIEYISMLSPTINEIKTLNTILTIPLIKMNEYEKNCIWRFRFQLLNRKETLGKFLKSINWNNKEEEEEAIILLNKWAKPGIENCIELFYSHLHHYVIKKYIIDIIKNSKKEEIKLYLFQLVQSLRTFNYQHIDNLFINTLIQKCIKSKKLSIYFYWFLLSEAKDKIKGKLYLHIHKLFINKLMTSNIRKNKIILDILKNQNRFRNQLLYLTKIAKNKTDRIQNKTRKLRNFLFYYRTNYGYINIKDFIKNNIFISDHNVYDFLDICKMKRENSLDTPMRGDNIGQPSYLGMVPGMGKSTDDSKNVYGDDNKNVYGDDNKNVYGDDSKNIYCDDNKNVYGDDNKNIYGDDSKNIYGDDNKNIFSDDNKNLYSDNNNNKHIRYNKYVKNISYEHFNEYPYDNKKSRNIYTCNKDICNSIYYLDNELTINYDIKDDLYFFQYKRSSDEKLLNTDLSNDSNDMIHYIDDSKNVKIERNRDNSFFSNFLQFNDNLDFFLNATYSDEDNNYEILDDSINFVQKQKIKKIKTPLILPIDPNIELLSFLPEQSYVLRSSLYPIVIACLVRKKIKLYNENYNNLIINNHTFYKNDQNKDNIINNLSYDKSYHSYYNSQFIKTLQNSFESTTSLNYHYNFLKCSNNNIFYKNKKIERIKPNTSIQKAFPSNENILNRNQHVYYSNNQIVHNIKKMNKHKRDDYMINEKVLPCVSNSCLGDKLMPSHDKMRSSHDKMMPSHDKMMPSHDKLMSPHYTLMSSHDKPVAPSGVSSLGEKKSKDEKKNRKKYNEIYQLSIKKYIYKAGDDLRQDHLVIQIIYVMDNIWKRYGLDLKMTLYRVLALSTDDGFIEFVDYAESISSIKKNYKGEIRQYFIDNSTCSSSPLGFDTEILQNFISSCAGYSVITYILGIGDRHLDNLMVTKDGRFFHIDFGYIFGEDPKPFSPPMKLCKEMIEAMGGAHSIGYEQFLKKCCLAYKYLRYHSQLIISLLDAMCDAGLKDMKMSPELCVLKVQEKFRLDLNDEAAEIYFLSVINASVKTLFPVVVDKLHEWALNWK

SEQ ID NO: 10 - protein, 3029 aa, Plasmodium falciparum
MSDRKEDKNDIILNKNEEEDNINNNNIILYKSFDDFKINYSYKTKNHLHENDKIKEEDDHEIKRKLIKLINTNFYIDKCIHFKKFSKDELYKTFIYSNFLTKALILYPSLMPYVECIIEKIKKIKNENITFFPAIEQFNFSIEHAVSSYQTGTQTFNNHPNFYTNYYQSFIKNDNIPYINQTNIFDNNIKNKYMLDDKFGSTSLYNNNNNNNNNNENNNDKYLNTYYASPRGNQIYNLFQDINNNHHNNNINSYSIHSGMTLYNIHRCICICLGVKKEDTDNYLHVFILNNGNIYGSGKKCSVSIIRKIQINTDRHITFKHIIKTPLYLYKSKEDKNKNNSNNNNNNNNSNNNNNSNNNNNSNSNSNSNNNTNSNSNSNSNSNNNTNSNNNSNSNSNNNNSNNNTTTNNSSSSNNSNNNNYYHNNYKNEKELNNSSSLEHSSIIMNNDNIHNNINNNHINNITDLNNMNVNQSNMKENNNIIDYMNNNNNNDNYSNNHLNNCINKLYTNNIYFTEDSQKRNPLQTYNTSKNTNNFLNVNNFTSSYNFPNINNMDSNIYNHTTCNNFNKNINNNINDISINKHNNIFNNMNHLNHLDNHSYIQNNLYKNHMNVNTNILYNNPIMNNINNDQINNLSIPNNKNEDNNEINHDDSNDDDSNSSHITLNKSDKNKNYFALNPKYQNHQNHNINNNIQNNLNEQIKEKNDQQNHNIKEIKNKELLNDTISSIEDTNDNSYSKYITSSDISQNNTLNSFQHNKEISVNFMYNNIILDNNNNINDDNNNNNNYFCIPCGYNTKEYKYNIYNTYNYPNNANHIYNNMNISYNNSAYNNNYVTYNNFHNSYHNNYILHNNFHNPYNIYDNIQNTEQKKLYNIYQNDERQNNSFNHINTDPHKVVNSNNFLPINTFHYNNNLNHNILTESNNLNRKNENDNIPSSYSQIHNHQICKKVEEYTYNSINQNTNNFNNNVMMLMNTSNNIPLDNNTYNSNKNKIIYKHIINDHINQKDNNVEYENLNNSCDNTQNKETFCNQDLINSSNINNNISSYTFQNNNDFYTKKKSMQYNHDNIYKINTTSENVGSPHTNNKTSIYNHKKGGYEQHTEQNNEQNNEQNSEQNIEQNIEQNIEQNVAQNVAQNVAQNVEQNVEQNVAQNVEQNVEQNVEQKAEQNSNNESIKTNTVETFKRNKNQITNSNNVISKQQHDTNNILNNININIKENINRHKINEFQWEKSNKIDIEKNNCLTTKYDKDNDNENDNENDNTYNKNNDIVICNNHNNSSHVQKNYYNMNESMINENNIIITEGENLMNSTEEYFTNELIKKDSLEKNKSDTKFLIKLNNEIKKEEEKKDNINIFINNNIYELKEINGNKNRSDYFHNTKDDKENITNVSSNNHLSVPLNKYNDEDKQLIKQMNHASNMNFIYDYNYHNNYSSTNSQQLIKNNTENLHSFKNETHSTYVKYIKSEINNMNNSIGVPTKKNDYMYTNYLNMEHIKMNNMEKEIIKKGNDNEIKGQRIQVEHDRDVHYNTTQENNIINNQNPQTNHDGDMNININSNKFMTPTTLKEKYQNNINTNEQHNKNEENKNKNVINNTSQMINDNNVIQNDINNMNNNENENENENLYINVHTQYKSDNILSCEKNFITLKNNNHNNHNNNNNYYYYYINNDNIHLNNSHIDIMKTNNINKDMTTNSTPHFKHNIISNDCSPNNINQNIFVDPNKYIYNNIHTNYNAYHEESLQVVGNHNSSSLLRNINESFSNQYDNKKNLEAHHIDDDKNKEAFHNDDDKNKEAFHNVDDKNKETFHNDDDKNKEALHNDDDKNKEALHNDDDKNVEAYHNDNYNDNYNNNYYFDGNNNMQDESFYSNNSHAEYNQSNIEYISNYDKNYSHIQQYTNGFCYTNNNQYINNTELTNNSSYIYNNSYMNNNTYSFNKEYSDNNMCHHKNDNIHMINDVATKLNQHPMNMYNSNNNNIIYNNNNNQIYDNNINNMYNDYYNYNNNNMYNNYYNYNNNNNMYNNYYNYSNKNFYMNEKYTEGATNFMNIDDMKDAGNENNMHILNNNSINQTYYHSKIKNNNNNDDDDNNNNNNNNNNDNNDNNNIMMHNNYQPFLYENQYNKHIHMMNQQIQKETNTSFKHITCNQKFIENNKINISNDQNVTNMPILYSMNKEQYINISNHNNGCNYDNINSINVYENNNEYIAPKNMLYKSEEKENLYNSSSIYNQNYEQKYINYMNNASYIMNNNMNDYTNNYNVQNFRTFKNNVFQQPLSYSNGSEAMLHASEFNQGINKENFQGEYVSNLVNSYKDNVNNVEGVLGIKKDKENDNNEEENDEEENDEEENDEEENDEEENNEEENKEAQNNEEENNNGDNNNGDNNNNGDNNNNGDNNNNGDNNNNGDNNNNNIFYNMEGSQKICHDDITLNECLNSIDINEGEKKTFEENKSSFSMLYLFGKVKFYISIIDIIHNKTNSHDLLWVPRCCNGSYGTFLKYNYSNMNEINKYTHDEGIDIDSINLKLMETRFSKNVASSRTTKRKRMIDIDKTVLHYYKEHISEFFNDKNKIIKLTKKLCKYKKKRKFNDTQKKGTYKDEKDYDNYDVLPNGDEQNHENKKQEDNNNNNDDNNNKNKNNDDDNNNNNNNNNNNNDNNNKNNHNNDNNNNDNNNKNNHNNNNNDNHKNNSNNKAKGKNMGKGKKQTPNRMNNTKNVQNGKNTKNINNIKNISNMSNIESINSMTSIKSVDGENRMNNTINMNGMNKTESINNIEITQNMNTINSINNINGINNINGINNVNGINHTNGINHTNGINNINTMNNMNNMNNINHINNINNMNNMNNMNRINSLNNKNNINPINQYNDEKQNLLNSHLQFNQVNYHNNLVNGLHKNNFLSNNNYINTTDINGNNMISHNDHMNNKLYSNINNNYYYNRANNEIPNNNSNNHNNNFNIYESKYQTMIHNNNIGQDLKQQINNYNENTSSNNNLSISQLLEGNTNFINISNTFINTNYSNDFHQTNDLLVNHNNIDLKYLSDNINTNTYNEQ

SEQ ID NO: 11 - protein, 109 aa, Plasmodium falciparum
MSMFLNILILIDAASVAFLLITFLMINLNEESLELSQAHRENGKKALVVAIILYVIFLVLLFIYKAYKNKRKLYTNFFMKKRNAPKYVQLASTYLSASDEYEQYELNKI

SEQ ID NO: 12 - protein, 395 aa, Plasmodium falciparum
MENEYATGAVRPFQAAESNERYQDPQNYELSKKAVIFTPIYYFDGNSWTALERLLSLKKTIFHDNRLVTLCPVENNITPIELEASISGKYDIKVYRHCEYILCIEGEQKILIKIPVTKNIITWNSEQRLPLLPKTWKPTIFLLNESNIFLRFIPDKCLVISQVSNSDSYKVNCINFSEGFCCCHPINNLALLYGEYQQNQESKIMKLPKLPISNGKYNYFIHFFTWGTMFVPKYFELSRGPLCNFKKNIIALLIIPPKIHISIELHSSSPVVCSMEYKKDFLITARKPNITDIEIYTIIQDQLIKYDFSYDLRLNKENASISHLNIPIGFKICNEEKEKKKKNSSHICKWTFIETKDQRTLNRSGNSSSEHIMSQDLACIFDAEKAMICCLLSNI

SEQ ID NO: 13 - protein, 307 aa, Plasmodium falciparum
MHDFFLKSKFNILSSPLFNNFYKRNNEDEYFKKDRNNNDDLGVMHNYADDSEWREHNKKDRMTSLKNELNEQLIYTYYNNFNNNYEYYNKSTEKLKEKNNEDEYNEEQEYEPTANLLQDKNKINDMNNFYNNFNKNSLFNYQNFQNADKNFLYLLNKKNKNNSTNENILVDEFKKLKNHVLFLQMMNVNLQKQLLTNHLINTPKIMPHHIIINNKTEVSSNAVSEIQNNKDKKKNGTMYILLKKILSSRFNQMIFVSSIFISFYLINKHWQRALKISQLQKKINSNFLLKSVRLFEESLGIRKNKYI

SEQ ID NO: 14 - protein, 1234 aa, Plasmodium falciparum
MKKKKKKKKMGYSGIDIKEINVKRKNSVYFDNVDVCNILKENNTYKQKKHISININRKCASYNNIYYINNDHPGLGKNISYYQNKDNMQLKHFFNSNKINIHDNKIKTTQSYSYYEPLRYPAFKMSDKIKSETNELKKMDTKKDVHMKDIHPKNHKISKNDDLGNNNIDNNNNNDDNNNSNNNNNNNIKCVSNRSTSNKHINRRNMCIFHNKINKKEKNINEQGEKNEHSKIDHKHFGNHILKDVKNKKKSNNIIPLLYEENKNNININSKNGNSNNLEHEHVQEKPARFHKKKRKKKQNKLAGNKIKNNGKNEEVKQSSVIEMEKVNYLDDKVNGNVEEKKKKKKKNKNKDKDKKRDEEKEEDKNKDKDKDKDKNNNNNNNNNNNNNKNNNKNKNKKKKNKINNNNINKNKDKDMSKNKRKNKNKNEVVEDNKNKQYLEKKENNINEIPKEVMYIPIEERCKSIVSSSDEENLYYEKPYEEVENYFEFIENKNLINPSDITNEVKFILHMTLLTLYKDQIKPSYGKIKKRLTCFNENLEIKYNFLNIYASLRNEYIVVRTKRNNIFVLLRETPKWFLGWVKTRCFKNSYPKKVWKKLIEYFLNMTKSNMNNNLYVSMYIPFIKKFYDKRFIFYLNEKDNEKNKCYEKIYNFSFLSFDMNEQKKKRNNFNVLFYIYNMYHNNFSYFSQCNDYYIKNVEKNFLLYYTYIFFNYDKNDLNNNNSNIDLSKKNYLCEDKNKDTTTTSNNNNNNNNNNNNDNNNNNDNNNNSSSCSNNNNSSSSSSSYNNNCNNYTSLYVEHLFNDKKENILQTDEIIKYDITKNLINEENNIDTTNMFDIFNNDIYEVADILKKKNFPILKDYSLGKIAHIIYLCLYNGLLLEENQKIIPACSSKNIISSIFYIKNKNSYLYDNYSHLNQNFYCDDNNISTYGYDYNESTSINLMTKEYDDKMDSFLNVYENFLKNEEGLFFSKKKNNKCDVNVSLNKCTEEFHIPAITNLEEAKFKIERLLKSSYKKCIYLLFFREKFLKKYKQNINPLIFGYNSLIEFLFYGCREVCKIYILNNNLLIVHLSYDIAKHINNNNEKEKDKEKEKEKEKENVIEEFYYSDYCYNKTENNNNKFNNSSLEVCTIMKDNAKKKNSFFITYSYWKYMSKKEKQNDILDNVSFLKGEQNYIFSDDIWKINKCSFDKTNPIQQSGKDIPLYYKNMKKINTGIFNMPNLVQINNYDFEFFSTC

SEQ ID NO: 15 - protein, 100 aa, Plasmodium falciparum
MYDADKCEAILVLDIPGFKIEDIDVEIGEGMLTVAGPRSQTELFETYGDSLVLHAKEREVGYFKRIFKLPNNILDDTAKATYKNGNIYIYIYIYIYFLQI

SEQ ID NO: 16 - protein, 253 aa, Plasmodium falciparum
MIKQNIKYTQIISIDNILNKIADPILIGFSSSFNCDIANKAVQREDEESMGVFCLKEKVKNKINKKYNKKNKDNIFKNDNNTFSVCEYTELNECILNNKELFKYGNICHHIITVDFLKHIVKNRIYNKLKLHKIIRKKQYTDIPSLINDNNEHLINSKVFCYEYFIFDIFKYARNILSLEVNRQKEFYPIKNKNNEYGILNAQKALSNLHKSWLQYKNINIIDNKDEEKIFVKYLPLFLMMEHSFLNCHKRGI

SEQ ID NO: 17 - protein, 984 aa, Plasmodium falciparum
MEGFVALLSFLVVLVFNKTIGYNIKSGNTSNNIKYVNVLDNDRDINTHSVLPEVENVIERKDIYRQINFMETFVSSNNMMHDREKHTSNDSGSYEITGIVDGMKIGHPISVALGSQYSNYFDYLQIVHLDYTNSRFSFTVGEGKYYLRTYGSTYMTPSAIKIKVPCEKCKFINSEYSGIIKIIPYETNNNLFIYNWVLQTSSPLALENINTVFSDEADLIHGNSLSEEFKIDSSAAATSLNTFYGIVLHGIWSSEYAERLLTVISEFPDCVKMSAHDKNARSKQRKNQKWILVNEDLGSFDMKMEVCEEVNCDYSAIIHVSKHAFEYSKKLVHNRGRNGRYYSRRVEKILIRALLSLDFSLFITYFQQKHGVTLLDPQYDYELITNMSGYSSNNYQSWNHNLEELVELATSWDEYPKGLQKVQGLSYLLRRKNGTKHPVYPTAPAVAFPAGSQNNSFIEFMESAFVNYVDISHLVIHEVAHFIWVNTVSKELKEKWIQIGQWYKEPLSPSEWATKLEVEFVSAYAHDKNPAEDFAESMATYVLNSKLLNSRSFDKFKWIQDNLFGGGFYITTGTHKFDVINLGNEVYYFPGKVTRVRAKVLGSPTEDKLVKIYISLLSSDGSEGCAKHGYARIFSEQQTFRDLYFHTEDRSPCSHKLYGEFTMNKHESRGRWTAESMIFTGENNIERYVGLGSFHFYLYVNNQNEDVEKPIPLLDSISIYTHNATETNDALLRLHVMVLENELIKEHGGPYASFAAHENKSYSYESRTYKMYPPEFNTLMLKADYFIRDINTRGFREVNMDSCKSYTNMDTRNLKCFQVLNPVTIPKYCIGSTYFLRQVSIEDIAGNLETVNISSDKYSARLHPIGVRDKQKPVVSNVRVSSKPANEYHDGETIVSLSFNVHDNLSGVYYIFVYLRDPHGGKHRSDIDRASLPTGTENKQINHKILLPKGSMGGTWMLEEIKAVDSCKNESRNIYTHSVYVQND

SEQ ID NO: 18 - protein, 1791 aa, Plasmodium falciparum
MFYIIYFVLACVLLIYIRIRNKATSTFFFFLSRFLLICGFCIELYDNISNDILNVLITYSFTVSYIFFMSFKILEALLVCISILLLTFGVYYEKNKNMIDICTHFCSNPYLSINNLDHMNISCLCKKQIVIFLISLLSFTLICLSMKYYEIFYLKKKFLFRYKQKVNLAKQIEILHTMLPNFLVEYLLISDPKNDGIMVGKNISGEDRGIISVIFCDIDDFQNMVSTLQPHVLVETLDNLYLYFDKCIKYFNCIKIETVFESYLAASGLSEKKNNALDKIMYDTKCAIKLAIAQLSAKYYISYKVLDTREHFSDNSTSYDKYINKNISLKIGIHTGKAISGVIGSVKPQYALFGDTVNTASRMKSTSLPDHIHVSYDTYKYLKEDNTFIWKERKVFIKGKGKMKTYLLVDILDDVKRKGESLNYYSSSNLLLSQLGSEAVSIYEEREDIKEGSMDIIKESSRDIIKEDSRDIIKEISTNISKSSSRNISKSSSRSISDIKEGQIIDKEDLIFKINRMKNKIDSRYSKRIDKESRDKISDKTNHVLDEVVKHSDIHLLNYEINNKRCKKMKGDTNNENKLIGDIFNMYDKKIKYIYKKNYKSKSMENISFIKHYRNTKYKKSDYLLLDNKGESKKFKRNTSYVLESPLHLIGDIVDNNIKRKKKKKEIKTIVSDDMFTSPVNIKEYNYNEQERKKEIVGNLSYDKTKKIFPFIKFTKEGRIKKKKIEKKEKKEKKENNNNFLYNDDYSSYSSPKYGDNENNFVIKYIRERKDFQKKFDHPNFNFSKFLHNYNPMKNKNKNKKNNKNVRRNEYPNYTSSSKDGVSYNFLSDSLFSSDNEYSSDNEYSSDSEKYYKKRFKKNKKIIKFDDLFTKIYIKKKRLLQMNNYDVKGKGKKLKNKGMERNKTKYKNVNEITKMKYFVNNENRDHEVNKEDISKSMQKYFLHISKHKKEQIEDKKKTHKYFHKNVECVYPYAGNNINHNFSRNEKRKYSINLYDHLDEQEKIKGKKKYFNKDKELIGSINKQTERKPKKKNKKNIENKKDKKKIRMITNKTKEKHSNSIISVEEQNMNHNNSLKKKEVNFTGKNEEYLNRANTNCSLGIKEMEEDVYEFHSNNIYYNNQTSYSDDINNTTKLKGMGNNTNDISKNKGKNKLGKKISFFSMNNKYHESEIMNEEDNKNMLNLTQSQIINKDKYNYFTHCPSLKKKKSVFTKINNLFKNYFKSIDVHEKFGFSKKFKFHSKDSDDIKGNNNKISKNRYNNNNNNNNSNYSNIDSGKYSHNNKKNHHHNNNKYHHHNNNKYHHHNNNKYHHQNNNYEKHHHSNNSRVMLSKGEKTEKNENVDYAYQFDNYDKKLLKKLTSNLQLNKKNVKNFNMFYYKFNDEELEEEYTRNYYREIINIDLTKKLIIIFIFTEIFLSLCNIIELSFYEKKLRYNDSIVIIWLIRSIYLFIITYIWIILKTKLKEYKNNSSKMMWTIFILNIFLCSWGIILIDLSCIHYSMLLGNKNERALFFMKDASELIICIQLIFIKNMLFKHKFFFFVFFYIFLIYSFSKLFSIHTCQTHICCSIILFISINILYFWYSEYLDRIQFLVKRKRNRMEKISQDFLTKILPRQVLEEYQNDNLQLTYKHEKIAFLFADIVGFTKWSKTVSPKEVLKLLQKLISKIDKDTIKLGLYKLFTIGDAYVATSQPNSSITDESEALEGILNILKLAKLILHNINTIKIQFNKHDFNMRIGLHYGSCVGGIIGSVRIRYDMWGLDVLIANKIESNGIPGEIICSEQFRHFFIQNEPQA

SEQ ID NO: 19 - protein, 1815 aa, Plasmodium falciparum
MYIFFFILFYFYVMSTYTFCFLPVLQTQLGKIINKVISSKYFFKNDDICYNKNNLDFKWYLKKDRKKSRKIKKKQKKRKRKMIMMKRGVENVKNADSSNNDVCHDQNNNNFNDPLVSKNTNYNYLYTNNNENNMKESTFLKIDESYLSTSYILNGKFVSGNNISDNKNDLNEKKYINIKRTNSHNDTSSLSISQNNFSKIKKKKGASSINSYDESSPNVSPPSMYSSENLSYNEKRHNNNSDNNNDRNMKSYNYSSSNINKNCSSSSTSSSISSSSISSSSIISSSIISSSCSSVTCSDSSLNIYNTKRSSHGSHNQFCGSMSCYEKDKKKNRLDNKNKMKNKNILNKKKKYKNKKMPKTIDGNDTSLLLSSSTSSCNTKVSFDNNENYGIIKEFSLCKINLFIKEAKLLFFNKNISISDVSLYVTTIMEDKKYIGKLRKLSSRTLPMNNLIINEYINHNIKDVYTDIIINIRYKNRKKEKEDIILGRAIIPLFLILNTYKWKIKKIKNKIRYCTKCFLWLHIFPCNNKLFNYKFFKPVEGFEEYGMLNPLYTLGFLNIQIKIIFKRNPLFLTFLSNIRKPLFYYKLPVQFEPLYCQYYSENLYVYAKNIPLWIYKFFYIFHYKRLEMISLNCYDYICILIFWLFFFDLVVLSPFSLIFVHLFFCIFFISLSYKYGKFVPPYYKKKNLFYNFRPIRVSRVSRRNCDYTKRRIETTNFILNDQKNVEIYNREKKLDLLDDNNVDANYCKYPYCSEENNMDKLNKDGRDVNKGVDKNIIKGKNMMTRGGGLNIYDACKMFIKGDTVMKANIINDNIVYENFIKDGIKKNDVMMDSEEDKEINAVYINNKNVYNNNNAPVSCHDCDDPNNLSVHVHKEENNSTSNKMILPSVCSENSLKETMGNQSMENNNKINNENNNDVDSVEKTDILLNLSNGKNNGNVTSSLCENLFVYNQDKIQRKKKVPYKNKERDNKDDLDEKKDMYICNDDSSVITSSEKGVTKERIHMNKEKLNYNGSMECSSVCVEKNNMSYIARRIQNMMYDTKEKMKLDQIHMNKHMSGFMKLFNVKHVENEKENDIDKYHDKGESDKQVPSSVGSYKLMISQEAEFEEEEFDEKEEFDEKEEFDEEEEEGGQDEESKKMSRVKHIKKRENIINIEGENILSSDGKKSEYIIKDSMNNTEYINDIIYYNNCDNILEDNKSEYNTSMNERVMDNKQEVNKRSNNFFFSYNNNNNNNNINNNNNNKNESVWRNLLGIPSSNIETVNLNSNNCTEIKNSNKKFNIIDTYGNNTLQDKSNIIDLRKKYPYMPFVKSPFHNFYLYMNTNDNKNISIFSNNVEVPNVHVILNRFITLITWTQHVSGIFTMVYEKIKYAFNWEFSFYTLVNILILFLICYSISFIIYMFSYIPFVFFRFLFFVTCSYFIIRSYELTEDGNRACLYYKKRKIQFLKNRKISLAHGLFETYKWKNIIKIIKKTLKKKDTNIFKYICLTCAFKIYKLFKIIFENILLYILFILFFIKNWYTRLLILKDIEHMQIAKLQGFKNLYFFIHNRIIKREQKNVMSNTSSNEINNRKSSVIKIVNIDDMEKNEENMNKNDNNHDKNDDIVDVNNVHMNINNDNMNTNNEYEIIKRRNQNNMLDGKRKSVKSLMYENYKNLESYVYSSSDKEAVSIINEDDIIDEEEEEGNHQKEKLNKDNINLDKKNINTYQDIHIDQEIQPCDDENDDKLSLSQVTDNGAMNVNVDIFLHYYFKKRKYDLFNNFININRNHMYTYKDINLFYSNEDQKMNNINYGEYLNSDDAYSSSYDYNKRQKKKHVK

SEQ ID NO: 20 - protein, 4544 aa, Plasmodium falciparum
MKDREDDEEKERNLLNFTENEDDLENVNMKSSTKGILDDDNIDNSDDNDSDNNNGDNSDDDDDDDDNNNNNNNNNNNNNFKKYKEEEEKIKKFIEIKKDINNIESCYMLNMFKFNLESFKMYLINIIENEALECAKNVIEPLKKKSDMLIKKINTLKIKLKKKIIDIDSLYYVINIIKKIHIFESTIDIVLNPINDMLNILEFYMSNFLKKQMDSLRHSNNYDEEENYQIKFINNLEKKKSSGQLYNLDDSYNKNLLFTFNKLNVMKKKFVSFYKFEVEKKNLILSKFNELINLTKHVEEEIQEKKTTMKNELINNIYSFKIDIKTFREHFLKMNFKSEHINPLNAFELLKRYKEEINMLKNKYNSYYKGESIFGLKHQTHSDLFLSSNEIHNFYSLYDLYVQLKEKLNEWKNLKWFDGIQKMKELKNEILSFEKKCSQLPKNLKIIVIYKNLMKEIFYFKEITPIVDELEKKNILKRHWIEIINILKEKKKKDITGKEKKIQKKSYADEQKDHPKDNINNKSNNNKNNNKNNNINNNNNQVINEKVHQIDPLVDMEKNNVLEDLNVQQMSNENKNVKQVELINDLEHQTNKTSTQKDVFEKNDNNDNNDKNNINLIHGDTDENMYNTSEFEDEKMKKKNIENKKRINDQTDEEIISKKDISFQDGGLLEESAYLDEEEYINNLNKLDLDNMDFFIKDIINYHLLKKKDDILDICDSAEKEASIEEKINEQYKIWNETCFQFSKWKNRDYACILVGSKVIEIQESLEESQILLNNINSTKYSKPFKSKLLLLLNKLSDCSDIVERWIKVQMLWCSMESVFTSGDIARQMPIESKRFHQIDKDWINIINIANESSIVIECCQSSMLKELLPNMQKGLESCQKSLESYLEGKRSKFPRFYFVSNLVLLKILSQGSDINIIQSELIKLFDAINYLTIKTIQNKKRIICINNKEKDDIETVQLVNHVTIDGNIENWLILLEKEMQKAIKKECKLGVSNSSQLFKTLNLKEFCDKNIAQVALICLQVMWTNDIEKCIYKYHSEKNILKVTNKKINYIMSELVNICLSDLGTKLNRTKYETLVTIHVHQRDLFTEISAKIKEHKIKTTTDFDWIKQTRIYYKVEKNIILISISDVDFIYSYEYLGIKERLCITPLTDRCYLTCAQALGLCYGGAPAGPAGTGKTETVKDLGRTLGIYVIVTNCSNQHKYKDMAKIFKGLCRSGLWGCFDEFNRINLDVLSVVAMQIESIVTAKKQSLKYFLFPGDSKSINLNPSSAYFITMNPGYAGRQLLPENLKIFFRFISMMVPDRQIIIKVKLASVGYLDIDNLSNKFKSLYNLCEEQLSKQKHYDFGLRNILSVLRTAGDTKRSAGPNENDEEMLLMRTLRDMNLSKLIHDDVLLFLSLLNDVFPKFHNITKKSFQLIEENVLQIIKKKKLCAKGKWILKILQLYETSLVRHGFMLVGNTLTGKTEILNILTSALTNIGSVTKIITLNPKAITSEHMYGVKDNLSEEWTPGIFANIWEKYNNNNLKYNTWIVCDGPVDAIWIENLNTVLDDNKILTLANNDRIPMTDNTKIAFEVENLNNASPATVSRAGIVYISDSDLGYRPFIYSWLQKLKDINTYGMTLYAIFNKLFIFYLDKIQILSFLKENCKFVMDITDSILILQTINLLNSQIIQYINAINNFMYNEEDLNKIFFLDTNEKKLLPHSQKLIKSNIEEENNIYEQENGIPSSEMKKGKDQLLNDEKYKSSNKLEDTKNMTLPNDLGKKPLFPTLEKKNDKYGKNLDNIKNEQKDQNDEEKNKKMDKKEADHDQQQDEEEKEQEEEYDDDTKLDGINNYTLSSGTKYEKVNIDECEEIMLYSIVWGLCGLLEYKDRLKVHNFLLKNVPVLKNVMGVNKKLYTEENEKIKQQQPKKKKELQPKGDYNDYVSTKQNKEEDKNNIELDNEQNVEDGEEFENEISLIYDFYFDMKLKKLVKWNVGPFKMPRNINSISSILIPTIETTKVEHIIKLISNIPIRCYNFHTYKSTLLLGSTGSAKTSIALLYTSKQEKNTKRFNFSSVTTPEKFQLFIESELERKTGKTYGPIGNTKSIIFIDDMSMPKINEWGDQSTLELLRQLIEFQGFYFLDKDKRGNFKKIIDLEYIGCINHPGCGNNDIPKRLKSKWFNVNILPYNLNSINTIYGTVLRTKFNKKQNFSDEIIENIDKVILCTINLFGRLKKHLLPVPSRFHYLYTTRDLAKIFYSMLLCPYESIDNNLYNFLCLWKHECERVLIDKLSRMEDKTFSLDQLKQIFNQYYPSYKDICEKNIYFSYFYVSEKEQQLYMIENDLIENNTTQEKTENNKINITISPSYINDTSNNLISTKLDNTNELNEKIDDTKTRSNSALYRRNDVDNQNIINNNNILTKEGDNNGDIDNINTFSFSWMKKDYKIVVDFERLRYIVYEYMKEYNINNVKKLDLVFFDDSLKHLIIINRVMQTPNGSCMLVGVGGSGKRSLTKLSVFISEQVLFQLNITKTYTKNLFFEDLKSLYISAGQMNKKTTFLLSDSDIEKNDFILEHVNSILSTGLVYGLFIKDEKEAICAEMKESYLKEMNKSNQSSKIKGGKKKKNKNDYNNIDDMDMDEFHSKDSQSKSDASSTSSIDNDSISNENITNKKKKKDEKVINDFNVSSNVIFDYLLDNVRNNLHIFLCFSPIHKEFALRYQQFPCIYNCVTINWFLKWPLEALVNVSTAYLNNFNIDIEDNLKDDFFNLFAIVHNKVSDTCDTYKERMRRNTYVTPKSYLSFIDLYKQMYVKKYDEIKCLKESVDIGLKKLNEAAMDVQKMRESLTSEEEKLKESDEQMNILLEKVKDESLKAEKQSVEVSKFRDKCIKEKDLILKDQEEADKDLKAALPYLHEAEEAIKSITGKDITELKSMKTPSDIIRIVFDGVLILLQGKLKEPKIDVKYVNKQHIDFIQDSFDEYAKPLMADIRFLNLLFDFSKNEKDNINEETIELLKPYIQSTFFKTQIAKKASVAAEGLCKWVGAMAMYNQASKIVKPKMSYLKIQTGRLEDALKQLAEAEDSLLKAQLFVENLNLDIENMFKKKKALEETALKTKQRIEQANKLINGLSSEKDRWTDDSNNFSNIKKKIVGDVFICSSFITYCGMFNTEFRNYLMNDVFYNYTKNIKNIPVSSNIDIIKYVLSSDDTKICDWSVQKLPNDKLSIENALICENSNKYVLLIDPQCQASNWIKNKEFQNDLSNQRCITTFNSTKFKDNLEYCLSEGKTLLIENVEEYIDPILDSVLEKQIIKKGKKNYILIENNLINFDEKFNLFMTTNIPNPNYSPEIYARCCVIDFTVTVKGLEDQLLGRVLTEEQKHLEITLKNIMIELKDNTKSLQDLDKQLLYKLNTSSSNLIEDEELIEVLNNTKLLSKELESKLKDSNEKKKEINEKREQYRSVALRGSILYFCIVDITNVNYIYNTSLHQFLEQFDLSIKKAEKGQHIKKRVESILYTLTNLIISYMERCLFDHHKIIFKLLISLKILLYDNIISNKDISFFLNPLSHYSPSNDMNNEMTNTNMLNDPMGVLKNKKNKKNNKEMINNNNNMSIAINAVINNTMDSSSMNNDTMNVYLGTNENDKNKKDTNTSDVMSSSSSTKTGSRTTTTTTTTTTTNNNNNNNNNNNMDGNSSNNAGDINSCKNNTSVTDHNISNKNKIDLHKKGAGKGKISSTKWLFKNEKLYKNIISLSNHSFGNDKNNRFFYDILNVIQLNENTWKNYYDILDIENKNIPYYNERLDVNSQISSFIKLCLIRCLREDRTILCANKFVDEVLNRNSDTIKHETLENIFSESSNRKPFLFLLSLASDPTNMIDDFAKKFKKYPTDKISMGEGQEVIAKEKLKNGIISGNWLILQNCHLNKNFIIDVYNMLKNLNEIEEDFRLFLTSEPDDEFPICILHGSIKISTSLSSGIKNNMRKIYKDIIKEDILEKIDDDKYRKIIYSLSYLHCVLCERKKFGPLGWCVPYEFSITDLFASYLFIEKHLYSTLLVNRPIDWESIHYMLAEVQYGGKVTDDLDRELLLTYVQYYFNEDLFRMKSEGSSEYLNLPKFYEITNFKNFIEKIPNIDTPSVLDLHNNAEITYRVNESRQVLNSILEIQPRDVDQGEEKSMETVVQEMCLGILQNLPTDINLEDVKKILYRKNKNIQPNMQTNTQLNVTCNLGATTKNFGILENSSYKGKNRDYNIDTNDNVNNNILQKSVMLNNPNNYTANVGKYIIPGDNKNKNLGLVKENELSLDIPDIAYWENDNEGEKNVQYNFSPLQVFFLQEMERIKKVIDLVKVNLNDIISAIDGSKIMTADLQNDTKYIFSQSVPKKWIYDASETEISWICNNLNQWLNILNLRYEQIMNYIYNGKLKSYWLPGFFNPQGFLTSMKQEITRLNKKDQLSLDEVVLYTDIKNYDVEKIKEFPEHGFNIHGLFIEGSKWNWQEGKLEESSPKILCENMPVIHITVVSNKDKKIKFIENNKHMFYNCPVYKYNVRTDKYFIFRIHLKSDIDPSIWKLRGTSLLCSKD

SEQ ID NO: 21 - protein, 2024 aa, Plasmodium falciparum
MKHTKITKYLTINFFILLTLVFQKYSSCQNSLNYSKNNYGLNDQELRAMLFGLNYDPSKRNKNNKVNRDVIKNESSLLLRNLINEETLSEKNDKVVNDIKNMNNSTEKKINSISKGNNNIHNINENQNANVELKTDNILDNTSEQDDINEKNNDNGDMVHKNIYNNILSDPYDINSTNAYINKSDITNLNYSSNDVINNDKVNKSYEEKNIVNNTELNKLIESDDHSNKNDINKKTEKNKTFNSSSTSDEKKQTDIKGQNKNDLNNEHIFNNNDINNNVQYKNKVNIISVDKNNTDRDNNNLYETNNGDLKYNNDLIKEGENKRNNKLNNYKFNMNKVNDNKNFNKYTEIYNKESEPEKQNNSNNNLGIPTLIKKEVHIKNHNTFSSNGKILENKDIDKMSDTSKKNDRNFRSNDIKNFKNNDTKNNATLSEDNKNRYNITTNKNNEKKEYNMKKSNENEYAFNTEKTNVNNDALKEERNNYKYLNNQTDVNINNLQERDINLYNKNESDKKLEQSFREEDIKNAYLPENKNFQKTLTNNEKNEDNKIPHIDPSNNELDKKGNYNKYEIGKIKKNNEENKQNVTVEENINPEKIRKDHEQNIQYSKNDPITDIQNSTNAVLKKIKPTEFENYTKEELQNVSSSEVRDDNLNEINRKGETNMFSEKSTLKKGENDWNEYEYFKLKSNELKVLGIINKYSPKGGFSISVNCGGYDDFREIPGISNLLRHAIFYKSEKRITTLLSELGKYSSENNSRIGESFTTYYAIGKSENIYNILTLFSQNLFYPLFDEDFIENEVREINNKYISMENNSLNCLKIISQFITDLKYSKFFFHGNYITLCNNVLKNGLNIKKLLYNFHKKCYQPKNMALTILLGKKGNSHDNYNMNDIENFVIDIFEKIKNYDYVNESNNKRQKEKHIVNFKDDTFNIEKKSNYKDSRLVHNVTQNNSKDKEEKIKFIEHINEFNNYVLDLNQKGRYIEVLKKEGWRDQIYLYWSSKISIDLYKKIEEYGSITFIHDILLDLRKNGLYDKICVENQYAYDLKIISSCNKYYVNYGILMNLTKKGKKDLRHLMHIINVFIKEISKLFDHDSLNKGINKYILDYYREKALITDVNYNNDNKYIELNDLINYSNILLDHSDDSSLILSINNLIEDKNKNDFRNHIKITSLLGSLMKNENTNIINVVDTFSIRNQSKIPYSNVTYVIGENPYMVNEGNIVNDINLILPEIKICPFNSLVNNKILFNEKSFFCVPYNSSENFEYSESEEKFISEENKHIFKSNILYNIPCLIKSSYGYNIYFKRGLTHISKVKTDFIFYFPSEKFTFYESVFTRIHIIILQKKIERFLSDYTTCSVNANIMHDAISYTLSIESNGYFFEEFFNKIQELLSLKEIPSRDEYNEAYDELNIIIQTDTTSGVDKSLKIMYSLFNKYTPTNKEMYDILNAYFFYPSYNAYRTYVNEYFLRNYVVIFIYGNIIISDLKGEENITKNNNNIFDNKKSMNYNEGDATDKNNNSNNNNVESANDSTNYYIYNENNSSNRDTNKYTDNDYNNNNNNNNNNKDGDKYLINEKIYEGEENKKNPTTYLKKQEQFLEKQENNNKEEENKSKSLQISYNGSGIEYLVKLCESFISKVTNKVIKKSESTYYTKKLINDEDIEIDMHDPGQDLSNSITVSYIIDSETLLNNVLINIIVDLISSDFIKFVKIKYNDGYVVEVRTFFTYNGLGGLLFIIQSFDKDVEQLESDICTFVKYITFQLLNIDISDLKKQLQNMKEHYIMNNTIFTFNQEYSSILDELITGHECFDKKYKIVQIFDELINCPNIILNKINYILRKSKKNIFKEYKKTNIVNIQSSNKDGTKGHDYLHLNEKCNYSYRKNMKMSNIQFSDNSELFIKKQRKKKYKYIPSNGTTQSNNIYKKEHLFNFSNFVEIKEKGFFKYIISYFRKNNRKYLNDDNYLDFESCDEEMSKDNFQIFYNFTNDINKIREYFRGKFTNDKEVKENCSINYEEIRKYCYDHNINKDNMIRTKIEI

SEQ ID NO: 22 - protein, 1471 aa, Plasmodium falciparum
MKCTSVNIRNVLDISLKKKIKENTNLSDDEIIIIYKRFNYISSNGKLNYDNFEKSLGILGSIQNAYLYKSIFKAFDLNNDNYLDFYEFCVAINIMLKGNKKDKLKLSYRIVNAGFNSNEDACVHKSSCMVNKFNTKEDNNMNGDNINGDNNNNHNNINGDNNNNHNNINGDNNNNNHNNINGDNNNNHNNINGDNNNNNHNNINGDNNNNHNNINGDNNNNHNNSHNNNSHNNNNKAENSLGQPLNEKNINDPINKHRNSQSIIYNINDEYNEKIKKNKKQDYSNYITYENFEKIVLSINDIKRQLLGTGDEIITSQIKYTFRSLSILCDDGIYRMNFECYKKALKCNEFLKLLGIHTKVADVFLQHELLKRKDKNKTKNGTMRNRKKYKNDSNRIANHLIIKSFSESTNTRGSIINDSTSFLFLRKQKKKKKKKKKKKKKKEKKAILYERKSTFSSSMENKSQNKSQNKSHNKNIKSVSRILSRVNKLSSTELIPNECDHKPNEEVKSTSDVLTPIFFNNGDEKMNHDTDGNMVYHKNNVDDNLVDGDVVSQGKRCSFFSSCENKKNEENKSITFNDINSGNINTNSCIMNNMIVTKESNEEIINEEAQSSYIYNKNIFCSKYNTKKDKNEPLKCDLFECSFINNDKNIVRDEDSNHKNVRKTDDYFIIDDNNIFDNGPIIISKNKTNDRERKLLKTFSSSSLKKKSLLKNYNYHIKKKNKDPNVEDTNMLYHDDIKKEYDHKVTKNNKNTCNNNYYNNVSFNSSAYYEYHSDIDLIHFSNNLKKKKKKNVTSPRPSSKEYERKVTYHKECCSNERMKNIKVNESDLGMFCVNNDKTNIEDVKEKKACDVLNRGCIKEQVQCKISEFENDKGNEIYMQEFKKCIEKYKEYVNQGEGHLKDEEEEKNDDEEEGEDGEDDEEENDDDDDDEDGDDDEDGDDDNDDNDDNDDNDDNDDNDDNDDNDDNDDNDDNDEKSNIKIENKKDVPNIHNNNDDDGINCCTNLFKDDDTLSALEKNVTNNNLIKIMSAKYLYHKFLEYKDFMKNNTTLFSHFNKIYQHEDDKINTDNKDVLNYRPKHNNDINYYNIPCEDQIKSDEKKSLLNVEFGDDIIKKKFFISSVNSHYVMINNNLTKEQMLYLIRNILMSIEDYLKKEKNRDYNKIFFLFFSIFIYNTQNGGDQKEMHEDEKWDHTNINEDKNVEKNDDYKNLSNNENSVYYNTMLRESLWNKKKYIKLNIFKNIILVISIVRYFLHTITISQKYTSSYDSLDDSNMIKSMNSLKLNEINILLNRASEILEKYSLGSVENKKVYINKSNYYNSSKKGKLSVSLRQNKQKKTFHRILAVYFGHERWDLVMNMMIGIRISSIKKFSINDISNYFHHKDVIQLPTSNAQHKVIFKNYAPIIFKNIRNFYGIKSKEYLTSVGPEQVISNMVLGNLSTLSELLSEGKSGSLFYFTSNGKYIIKTVIKKKK

SEQ ID NO: 23 - protein, 2647 aa, Plasmodium falciparum
MAPLGRRGTNKSAKEVLDEIGETIQKKAHSDADTFRSQLKGNFGEAKFYNGGEIMQPNSKLCELDHTIDTNVTDGHSNPCEGRQTVRFPDDNRSQCTKNRIKDSVDNSVGACAPYRRLHLCSHNLESIQTNNYDSSKAKHNLLAEVCYAAKFEGESIVKNYEQLGHHTTEGICTALARSFADIGDIIRGKDLYLGNPQESARRKQLEDNLRKIFEKIYKELTSSRNGKTNGAEERYKDGSGNYYKLREDWWNANRLDIWKAMICKAPGNAPYFRNTCSNGEKPTGEKCQCIDGTVPTNLDYVPQYLRWFEEWAEEFCRKRNLKLQNAIKNCRGMDDDGKEKYCSRNGYDCTKTIRSIDKYSMNRECTKCLYVCDPYVKWIDNKKKEFEKQKKKCENEIYRNNESSQNSPKNYNNMYETDFYGNLKKDYQSMNDFLKLLNSETPCTNIIDAKSKIDFTKDPEETFSHTEYCDPCPWCGLKTQADGTWKRLYENDPQCPIKPKYEPPKGVEPTETDVLYTGKENKDIIVKLREFCKTDGNTGFKNEEWNCYYQVGNDKCVLENGEELGGEKKVKDYDNFLMFWVAHMLKDSIEWRSKLSNCLKSDKKTCITTCNDNCQCYDKWIGKKKVHWTQIKKHFDKQTDFQGWGHYFVLETVLEGDQFFTDITKAYGDAREIVHIQEMLQKKKEQVLHEDASNMKTIIDELLDHELKEAKQCIVNHKDNNCPADLSDSEDEEEDIPQRQNKCAKPSGTHIRALVNKVASNMHHKKKRQLVNRGVSSKLKGDAAKGEYRKSGTTIKLKDICSITDDHSNAKRGHTDQPCKRKDSKVNVKNRRWMDTAGFISNTYKDIYMPPRRQHFCTSNLEYLQTTNKLLNGNDINGNPNIINDSFLGDVLFAANYEADFIKKMYNKQNDYKDNATICRAMKYSFADLGDIIQRQHICRIMIVERVKHEISERNFLILSKKNILAFKEIYKEDTPYTKLREDWWEANRKKIWEAMQCPTPNGSFPCKSYHIGLDDYIPQRLRWMTEWAEWFCKEQKKQYGELVSASNGCKDERVKVVRIRVHNVQRACKHVKIIKNLLIHGKEQWDKMEIKYKLLYLQAQTTAANGGPDTYSGLVDENEKPVVNFLFELYKENGGKIGNPRDTPRAKRSKRETAPASVAKNDVYSTAAGYVHQEMGPHMECKTQTEFCEKTDEQYNENYTFKNPPPQYKDACICNTRPPPKEDSRKRSEDSDEEEKVKETKVEEKATEDAVDTGPPPAPKEATTTLDVCPIVAGVLTKENLENACPTKYGPKAPTSWKCIPTEKTNAATGSEGSSGNGALQRAKRATVESGSPVTSNSGSICIPPRRRRLYIQKLHDWASGNTVVSGQAQTPQGGTSSPSGKETPSDKLRTAFIQSAAIETFFLWDRYKKGKAIAKKEKKKQMVDYSPLSTADPHNNPVSLVIAPNPNYNKTCVIPPPFLRQMFYTLGDYADIFFGKNDIVIDTKNGDKDIAEREKKIKDAIERVLKNADSQPPSDEKRQTWWEQNGEHIWNGMICALTYKEKDEKGTPLKQNEGLKSALWDEKNKKPKDQKYQYDKVKLDENSGTSPKIVVPAPKPTTTFPPPPSPTSFSRPPYFRYLEEWAETFCRERKKRLEKIKVECMDEDGKKQKCSGDGEDCEEIRKQDYSTVRDFYCPECGKYCRFYKRWIGKKKDEYDKQKEAYNNQKTDARRNNNDNAFSTTLDTCTTAGDFLQTLKNGPCKNDNVDDSGENKKIFDENGDTFKYTQYCGTCSLNGFKCNGDDCRVRTNVTCNGSNRTTTITADDIKNGGNSAEINMLVSDDINSGNGFNDLEACKNANIFKGIKENKWKCVYFCKSDVCGLKKNNDIDQNQIILIRALFKRWLEYFLDDYNKIRKKLNPCINNGEKAICTNGCVEQWINHKRTEWTNLKSFNEQYNGDDTERNPRLRFFVDLIRQIAATIDKGNHNGLVKLVKSVKCNCGNNSQNGKEGEENDLVLCLLQKLEKKAEKCKDNPETSGIPQQPCEVSPNHIEDEEQPLEEEENTVEHPKICDDVLKHNHNQRNQERLVKNPLVQPTLKRKKKKKKRRKKIKKKNQDFHPRHLPCGAFINTNTPKTKTPPSSGKNPWEHPAVIPALVTSTLAWSVGIGFAAFTYFYLKKKTKSTIDLLLSLIPKSDYDIPTKLSPNRYIPYTSGKYRGKRYIYLEGDSGTDSGYTDHYSDITSSSESEYEEMDINDIYVPGSPKYKTLIEVVLEPSGKLSGNTIPTSGNNTTASDTQNDIPTSDTPPPITDDEWNTLKHDFISNMLQNQPKDVPNDYTSGNSSTNTNITTTSRDNVDNNTHPTMSRHNVDQKPFITSIHDRNLYTGEEYNYNVNMVNTMDDIPINSHNNVYSGIDLINDTLSGNEHIDIYDELLKRKENELFGTNHVKQTSIHSVAKPTRDDPIHNQLELFHKWLDSHRDMCEQCKNDNERLAKLKELWENETQCGDINSGIPSGKLSDTPSDNNIHSDIHPSDIPSGKQSDIPSDNNIHSDIPYVLNTDVSIQIHMDNPKPINEFTYVDSNPNQVDDTYVDSNPDNSSMDTILDDLEKYNEPYYDVQDIYNDVNDDNDISTVDTNAMDVPSKVQIEMDINTEIFEEEYPISDIWNI

SEQ ID NO: 24 - protein, 1781 aa, Plasmodium falciparum
MNEELNKMINSFQIKEKEGKEVNKNNNIEKNQNIDLNIYPNMSNYVDIGSNIYVEQIKNISKEEVTKKKSILNSKYISSKNNEFVVAQLYELNNYNENNIYEDRNLFSNSTNIYSNDNNMKKYLIQKCGKKNIKKRMDILNQENNNMGIHKNIVYDDNNNNKNVTYDDNNKNVTYDNNNKNVTYDNNNKNVTYDNNNKNVTYDNNNKNVTYDNNNNNSCSIIKYELRKTSICKYWIKGICANVECNFAHGEHELKYTFGVYKTTICKHWKKNGMCSSGIHCRHAHGESELQPKNLPLHLLKKKNNLKNKNQTKSFHTNKELTINEYNDRSANNRNVEHMYKNKVDPLKNNNNNNDNIYYYGNEENQKDVNIFRMDTFYNNIFDSRNHMDKPPPHNINNNNSNNNNNNNIVSVEGKPINHNTPNILNDGNYTNHLNHSNYIYNNEKEENEKRNFNYYDTCKNIWNYQICKDDNNLLNNNEKTFFFFSNVNNNKMVECNNMNNIFNDIHKKENTITLNNNSNNVINIKKNIIDDADISKVTNVHIYKDDHLKNTPINNKKKETRLSQGKKNTYLKVNFFNNKNKDNNYNNNIIVDTNNNNNNNNVIKNDHNKINNNNLIFQNSRFMDHTGACDTIKSGDTTKSGDHIKSGDHIKSGDTIKNVENFVNYTNSNNISNINISINCNNYEKYINNMSFINNKESSNINKDDVYNGNMDNHNHHVNNNNTLCNTSLSDLCSNNSSESKKQEAVCLNKNDTHDIIKNVSNNMKRFSLYMNPINNNNNNNNNNNDDTSNNVQFINNYTNDYFYYDEKKDEEQHNPYDNKNNKIKGFRNINIRIIKKEDEQEHTNEKNNTIFNKNVNEIMYSKEITNMNNINRSSDEYITNNNMDNDNNIMNNTLYPWKENKFKNVDMLNIYKINKDDYLHTDIVKNIDCVISPYKDPNIIMDRINDDNNINMDNLLFTYNEQMNNHHNNKKWNVFNNSIILEKNEKITNSKKKNNYKIHQRQNINKNVSDNNENINNKNVISKDKFKIINSYIDYKLNYHKNNKYSYNNMEHNIKNVNEQSSINNNNNNNNNILYTTTKDLRNNIHTINFNDTKNIINSDDYFVDHNYNYNYNYNYNYNYNYAYDNIELSNKNMKDVINLYTYVVNKKNEKNIYTSTNNIICNDEYIKKEDCGDCQMVESTQMFDEEINCSPENKSNNNNNINSNNININSSSSSNNNNNNNNYYYNDYHDDDNNNNIMNHSYYNHINDSYYYQFNDLHSKENQQKYTYNINNLIHNMKLLNTEYESPLNSEQEKTILKNIAVDRNNNININNITLPTLQDNQMNNYKKYTNDLGSVSEGYTSTYNDTLKMHSETFMDSQNGMYILPQYVTRECINSPYDSSLFTDENREEKKDNKEREIIGNMLYDEHICMDDEDLFGRSHLFNIFNNEEEIDINQKDNYYDRDDHNDYHRDDHNDYDRDDHNDYDRDDHNNYHRDDHNNHHRDDNNNHHRDDHNNHHRDDNNNHHGDDVIYEETKKTDNIEIPLKDNDIMINNSYNDSLINYNKYFVKEHEYNNINNNNKIEENLKIKNSYDTSSKQNYKENNMFHDVDNFTSLLLHINNYNEKDFMNFKNEDYTLNKEIYFNECKYVKEIKNIDQDNTKELGIVLQNDDQISESDMRTKKMIYSIFIKEEETKKNKNLENICYTNEQEKYNNLSIINQKQNITMDIIKNVDELSFDNMEQMNIKINDNQMYNEQVMDNMEDRIEKINILTNDNIQNGIHNNNNNIIEEKQSLKDNN

SEQ ID NO: 25 - protein, 188 aa, Plasmodium falciparum
MDGPLAIISMDKSLFFKSLKNNNMLESTGINEENYLNALTDDTMNETVFLDYVKGKMMDVYKETNMNRYNVINHIYLTSKVWDTYNYLTPTLKVKRFRVFKDYSFFIDEVKKIYENKLKKSTICNKAILINRNKNVEMKKGLNDKNETSEKKVEENIKNRKCQNEVKEYSKKDTRLNVHNVKELERNK

SEQ ID NO: 26 - protein, 96 aa, Plasmodium falciparum
MNKTQKKRGKHDALTYMYCVYYDNYESLCTSQISIFCNLRRNVFSNFNRNDLIDQNIVYLNVCNNETYYNKAHEENDKVKGYIYEEGLHDNMFFSF

SEQ ID NO: 27 - protein, 1464 aa, Plasmodium falciparum
MELIKDDIKKKKHKKKMGRRYSYNDNIEELKKLKKILLNLDVLIDVSKIVIQKNENFDMELLNNVNDRFVEKIYYLLKDKKKNMLPEEELVEFIFLLLKERNEYNNLEKKKKNIYINVQKNLTNCPIKNEVTTLIQKINKFYYYFKEFLLKEKYNTKDDANKKYHHNKEDTNNYNNIPENYKNQSKHNHDYLNYHKDNIINIDINDLGYNNNDNNKESVFYNKEIIKNNKQRNHFQGKEKKNTKDEVATTIHNILSCKDISSNQFNNYNNTLQTSDYNKDFLYKDVLMDIMSTDSEKNMTSQKSITSEKNMTCEKNMTCEKNITCEKNITCEKNITCEKNITCEKNITCEKNITCEKNITCEKNITCEKNITCDKNIIISKRKDNQQTFCEDKISVSSDDIEPLISSYSEYIMRDEPTYIPDKKLLSEEENKKLEKEHCHMKNNIKHNDIAHVTNNDSINNYLYNKYYINEDNKIMQNDSNLNHNKNEDIKKVDIENTHMINGYDPNEDILWNNNKTISSEKLCVPRTKDNEILKNKELNNYLGEAYNDCINEETYKNMKLENCDEKKKKTNFQNVNSNFKEQHLLFCNNLQEQMKYRSDKNLKYDEKLYNNNINNNNNNNNNNNNNTNDDIKIVKPNNQHHIHNNLLHYINNKHNLLNSITLSNSLPQKNDYQINNFIHKNDTNEFKNLTINNFQKKEKELYTLNHMNTIKSNINNIHMKDSGDTEVTHNNQSFFFNTNQIENEKKKKNNNNNIKTHIANFNIIHKNNLNESGKNMEHYIASQEENILFENKNNDMEELYREHSRELLEENIINKIGNNTKKKKEYDECTMSTCIDNVVYNSHDNINGEKKDENNMEYFIKSEDESLKDFDMLLYNNRKENSEREEDKSIENIKMLGTESFYEDENNDEDIKQFDENLTYEQRKINDDNYGDMHYIDVEDDDYENVRNKNEDSSNIYDDEEIYNQKEEHDGKKIFLNRIENNAINNLYKTYEMIQGDNDDMDDNYYLYDENEKGATKNILCEFNKKGKKGIVNKFNRDMLQKIEKNYDNNDINNDNNNNDNNNNNDNNNNNNNNNNNNNNNNNQKKFMNTRNDNYINNNIYLNKANPNIFNENTTNYNQKENSFNQSDFLLLKKKEQGNSRLKKWLCKINAREKEKEKKLQQKKNESYDRELKNCTFHPTLNNNRIKREGTIKEMNDTYDDDDNKNLSENYDCYNKYVNDTYYGDNNKDCYNFDQEKIYDFNNNSYYKNNEQNHSFHHFNIDKKRNDNTNMKKKMNRNKILYLKGLKSKELLLQKKIDYQNEEEKKFKKECIFHPTIKDNVKIFLSDLPNGYNKTVDRIKRGVEEKKRINNFLQYRIPHMNNNGNIQNEKKNEGKQNNKKKTNNIPQPFSFDKGQYKVKIKPVFFERKIKISENKIACLAVREDEDPLYIVDIFCKIHALKNENKQILYDYILDELKQESFEK

SEQ ID NO: 28 - protein, 9 aa, Plasmodium falciparum
  MISC_FEATURE (1)..(9): Peptide No. 98.0038
KTNKWEDIY

SEQ ID NO: 29 - protein, 9 aa, Plasmodium falciparum
  MISC_FEATURE (1)..(9): Peptide No. 98.0039
KSIYIFYTY

SEQ ID NO: 30 - protein, 9 aa, Plasmodium falciparum
  MISC_FEATURE (1)..(9): Peptide No. 98.0040
GTFTFQNMY

SEQ ID NO: 31 - protein, 9 aa, Plasmodium falciparum
  MISC_FEATURE (1)..(9): Peptide No. 98.0041
CNDGNILYY

SEQ ID NO: 32 - protein, 9 aa, Plasmodium falciparum
  MISC_FEATURE (1)..(9): Peptide No. 98.0042
YFECIMKLY

SEQ ID NO: 33 - protein, 9 aa, Plasmodium falciparum
  MISC_FEATURE (1)..(9): Peptide No. 98.0043
VYEGKLKKY

SEQ ID NO: 34 - protein, 10 aa, Plasmodium falciparum
  MISC_FEATURE (1)..(10): Peptide No. 98.0001
VVDLFCGVGY

SEQ ID NO: 35 - protein, 9 aa, Plasmodium falciparum
  MISC_FEATURE (1)..(9): Peptide No. 98.0044
FSSINTYDY

SEQ ID NO: 36 - protein, 9 aa, Plasmodium falciparum
  MISC_FEATURE (1)..(9): Peptide No. 98.0045
VSNVEDSNY

SEQ ID NO: 37 - protein, 9 aa, Plasmodium falciparum
  MISC_FEATURE (1)..(9): Peptide No. 98.0046
NSNYNKKLY

SEQ ID NO: 38 - protein, 9 aa, Plasmodium falciparum
  MISC_FEATURE (1)..(9): Peptide No. 98.0047
KVSDEIWNY

SEQ ID NO: 39 - protein, 9 aa, Plasmodium falciparum
  MISC_FEATURE (1)..(9): Peptide No. 98.0048
ISGEGLIIY

SEQ ID NO: 40 - protein, 10 aa, Plasmodium falciparum
  MISC_FEATURE (1)..(10): Peptide No. 98.0002
FVEDSSSFLY

SEQ ID NO: 41 - protein, 9 aa, Plasmodium falciparum
  MISC_FEATURE (1)..(9): Peptide No. 98.0049
DSDSSNVLY

SEQ ID NO: 42 - protein, 9 aa, Plasmodium falciparum
  MISC_FEATURE (1)..(9): Peptide No. 98.0050
SQDVFIIEY

SEQ ID NO: 43 - protein, 9 aa, Plasmodium falciparum
  MISC_FEATURE (1)..(9): Peptide No. 98.0051
NSMFHIIMY

SEQ ID NO: 44 - protein, 9 aa, Plasmodium falciparum
  MISC_FEATURE (1)..(9): Peptide No. 98.0052
SSYNLFEEY

SEQ ID NO: 45 - protein, 9 aa, Plasmodium falciparum
  MISC_FEATURE (1)..(9): Peptide No. 98.0053
SSGKTFICY

SEQ ID NO: 46 - protein, 9 aa, Plasmodium falciparum
  MISC_FEATURE (1)..(9): Peptide No. 98.0054
ILENILLSY

SEQ ID NO: 47 - protein, 9 aa, Plasmodium falciparum
  MISC_FEATURE (1)..(9): Peptide No. 98.0055
FSDLILYVY

SEQ ID NO: 48 - protein, 9 aa, Plasmodium falciparum
  MISC_FEATURE (1)..(9): Peptide No. 98.0056
HIENILLKY

SEQ ID NO: 49 - protein, 9 aa, Plasmodium falciparum
  MISC_FEATURE (1)..(9): Peptide No. 98.0057
FVEALFQEY

SEQ ID NO: 50 - protein, 9 aa, Plasmodium falciparum
  MISC_FEATURE (1)..(9): Peptide No. 98.0058
PSDKHIKEY

SEQ ID NO: 51 - protein, 9 aa, Plasmodium falciparum
  MISC_FEATURE (1)..(9): Peptide No. 98.0059
IMNHLMTLY

SEQ ID NO: 52 - protein, 9 aa, Plasmodium falciparum
  MISC_FEATURE (1)..(9): Peptide No. 98.0060
LIENELMNY

SEQ ID NO: 53 - protein, 9 aa, Plasmodium falciparum
  MISC_FEATURE (1)..(9): Peptide No. 98.0061
NVDQQNDMY

SEQ ID NO: 54 - protein, 9 aa, Plasmodium falciparum
  MISC_FEATURE (1)..(9): Peptide No. 98.0062
SSFFMNRFY

SEQ ID NO: 55 - protein, 9 aa, Plasmodium falciparum
  MISC_FEATURE (1)..(9): Peptide No. 98.0063
NHEQKLSEY

SEQ ID NO: 56 - protein, 10 aa, Plasmodium falciparum
  MISC_FEATURE (1)..(10): Peptide No. 98.0003
LSEYYDXDIY

SEQ ID NO: 57 - protein, 9 aa, Plasmodium falciparum
  MISC_FEATURE (1)..(9): Peptide No. 98.0064
QEEQKKYIY

SEQ ID NO: 58 - protein, 9 aa, Plasmodium falciparum
  MISC_FEATURE (1)..(9): Peptide No. 98.0065
DSQNELTNY

SEQ ID NO: 59 - protein, 10 aa, Plasmodium falciparum
  MISC_FEATURE (1)..(10): Peptide No. 98.0004
FSFFFSLIDY

SEQ ID NO: 60 - protein, 9 aa, Plasmodium falciparum
  MISC_FEATURE (1)..(9): Peptide No. 98.0066
CHEMKAEFY

SEQ ID NO: 61 - protein, 9 aa, Plasmodium falciparum
  MISC_FEATURE (1)..(9): Peptide No. 98.0067
MFSSIFENY

SEQ ID NO: 62 - protein, 9 aa, Plasmodium falciparum
  MISC_FEATURE (1)..(9): Peptide No. 98.0068
NSLILLNLY

SEQ ID NO: 63 - protein, 9 aa, Plasmodium falciparum
  MISC_FEATURE (1)..(9): Peptide No. 98.0069
YIDNDINIY

SEQ ID NO: 64 - protein, 9 aa, Plasmodium falciparum
  MISC_FEATURE (1)..(9): Peptide No. 98.0070
EEDKTYELY

SEQ ID NO: 65 - protein, 9 aa, Plasmodium falciparum
  MISC_FEATURE (1)..(9): Peptide No. 98.0071
KTYELYQKY

SEQ ID NO: 66 - protein, 9 aa, Plasmodium falciparum
  MISC_FEATURE (1)..(9): Peptide No. 98.0072
CTHISYYKY

SEQ ID NO: 67 - protein, 10 aa, Plasmodium falciparum
  MISC_FEATURE (1)..(10): Peptide No. 98.0005
FVDEEGEQLY

SEQ ID NO: 68 - protein, 9 aa, Plasmodium falciparum
  MISC_FEATURE (1)..(9): Peptide No. 98.0073
NSLYNKIEY

SEQ ID NO: 69 - protein, 10 aa, Plasmodium falciparum
  MISC_FEATURE (1)..(10): Peptide No. 98.0006
YSSASESNFY

SEQ ID NO: 70 - protein, 9 aa, Plasmodium falciparum
  MISC_FEATURE (1)..(9): Peptide No. 98.0074
ASESNFYKY

SEQ ID NO: 71 - protein, 9 aa, Plasmodium falciparum
  MISC_FEATURE (1)..(9): Peptide No. 98.0075
ASGKLFSLY

SEQ ID NO: 72 - protein, 9 aa, Plasmodium falciparum
  MISC_FEATURE (1)..(9): Peptide No. 98.0076
GSNKVSDWY

SEQ ID NO: 73 - protein, 10 aa, Plasmodium falciparum
  MISC_FEATURE (1)..(10): Peptide No. 98.0007
FQDNYLKLDY

SEQ ID NO: 74 - protein, 10 aa, Plasmodium falciparum
  MISC_FEATURE (1)..(10): Peptide No. 98.0008
FFDYNSQYYY

SEQ ID NO: 75 - protein, 9 aa, Plasmodium falciparum
  MISC_FEATURE (1)..(9): Peptide No. 98.0077
FFDYNSQYY

SEQ ID NO: 76 - protein, 9 aa, Plasmodium falciparum
  MISC_FEATURE (1)..(9): Peptide No. 98.0078
MLEQKLSNY

SEQ ID NO: 77 - protein, 9 aa, Plasmodium falciparum
  MISC_FEATURE (1)..(9): Peptide No. 98.0079
NSFNNSNIY

SEQ ID NO: 78 - protein, 9 aa, Plasmodium falciparum
  MISC_FEATURE (1)..(9): Peptide No. 98.0080
CSSTKDLNY

SEQ ID NO: 79 - protein, 9 aa, Plasmodium falciparum
  MISC_FEATURE (1)..(9): Peptide No. 98.0081
YDDDKYNKY

SEQ ID NO: 80 - protein, 9 aa, Plasmodium falciparum
  MISC_FEATURE (1)..(9): Peptide No. 98.0082
GTYGNMENY

SEQ ID NO: 81 - protein, 9 aa, Plasmodium falciparum
  MISC_FEATURE (1)..(9): Peptide No. 98.0083
FTYYSCKNY

SEQ ID NO: 82 - protein, 9 aa, Plasmodium falciparum
  MISC_FEATURE (1)..(9): Peptide No. 98.0084
YDERNTLVY

SEQ ID NO: 83 - protein, 9 aa, Plasmodium falciparum
  MISC_FEATURE (1)..(9): Peptide No. 98.0085
STDDSKNVY

SEQ ID NO: 84 - protein, 9 aa, Plasmodium falciparum
  MISC_FEATURE (1)..(9): Peptide No. 98.0086
FSDDNKNLY

SEQ ID NO: 85 - protein, 10 aa, Plasmodium falciparum
  MISC_FEATURE (1)..(10): Peptide No. 98.0009
YLDNELTINY

SEQ ID NO: 86 - protein, 9 aa, Plasmodium falciparum
  MISC_FEATURE (1)..(9): Peptide No. 98.0087
STTSLNYHY

SEQ ID NO: 87 - protein, 9 aa, Plasmodium falciparum
  MISC_FEATURE (1)..(9): Peptide No. 98.0088
GLDLKMTLY

SEQ ID NO: 88 - protein, 10 aa, Plasmodium falciparum
  MISC_FEATURE (1)..(10): Peptide No. 98.0010
YTFQNNNDFY

SEQ ID NO: 89 - protein, 9 aa, Plasmodium falciparum
  MISC_FEATURE (1)..(9): Peptide No. 98.0089
HTNNKTSIY

SEQ ID NO: 90 - protein, 9 aa, Plasmodium falciparum
  MISC_FEATURE (1)..(9): Peptide No. 98.0090
FVDPNKYIY

SEQ ID NO: 91 - protein, 10 aa, Plasmodium falciparum
  MISC_FEATURE (1)..(10): Peptide No. 98.0011
NVEAYHNDNY

SEQ ID NO: 92 - protein, 9 aa, Plasmodium falciparum
  MISC_FEATURE (1)..(9): Peptide No. 98.0091
YSNNSHAEY

SEQ ID NO: 93 - protein, 9 aa, Plasmodium falciparum
  MISC_FEATURE (1)..(9): Peptide No. 98.0092
LTNNSSYIY

SEQ ID NO: 94 - protein, 9 aa, Plasmodium falciparum
  MISC_FEATURE (1)..(9): Peptide No. 98.0093
SSSIYNQNY

SEQ ID NO: 95 - protein, 9 aa, Plasmodium falciparum
  MISC_FEATURE (1)..(9): Peptide No. 98.0094
GSYGTFLKY

SEQ ID NO: 96 - protein, 9 aa, Plasmodium falciparum
  MISC_FEATURE (1)..(9): Peptide No. 98.0095
DIDKTVLHY

SEQ ID NO: 97 - protein, 10 aa, Plasmodium falciparum
  MISC_FEATURE (1)..(10): Peptide No. 98.0012
FNDTQKKGTY

SEQ ID NO: 98 - protein, 10 aa, Plasmodium falciparum
  MISC_FEATURE (1)..(10): Peptide No. 98.0013
LSASDEYEQY

SEQ ID NO: 99 - protein, 9 aa, Plasmodium falciparum
  MISC_FEATURE (1)..(9): Peptide No. 98.0096
SASDEYEQY

SEQ ID NO: 100 - protein, 10 aa, Plasmodium falciparum
  MISC_FEATURE (1)..(10): Peptide No. 98.0014
FQAAESNERY

SEQ ID NO: 101 - protein, 9 aa, Plasmodium falciparum
  MISC_FEATURE (1)..(9): Peptide No. 98.0097
QAAESNERY

SEQ ID NO: 102 - protein, 10 aa, Plasmodium falciparum
  MISC_FEATURE (1)..(10): Peptide No. 98.0015
ELEASISGKY

SEQ ID NO: 103 - protein, 9 aa, Plasmodium falciparum
  MISC_FEATURE (1)..(9): Peptide No. 98.0098
LEASISGKY

SEQ ID NO: 104 - protein, 9 aa, Plasmodium falciparum
  MISC_FEATURE (1)..(9): Peptide No. 98.0099
NLALLYGEY

SEQ ID NO: 105 - protein, 9 aa, Plasmodium falciparum
  MISC_FEATURE (1)..(9): Peptide No. 98.0100
SSPLFNNFY

SEQ ID NO: 106 - protein, 9 aa, Plasmodium falciparum
  MISC_FEATURE (1)..(9): Peptide No. 98.0101
LNEQLIYTY

SEQ ID NO: 107 - protein, 9 aa, Plasmodium falciparum
  MISC_FEATURE (1)..(9): Peptide No. 98.0102
QNADKNFLY

SEQ ID NO: 108 - protein, 10 aa, Plasmodium falciparum
  MISC_FEATURE (1)..(10): Peptide No. 98.0016
FVSSIFISFY

SEQ ID NO: 109 - protein, 9 aa, Plasmodium falciparum
  MISC_FEATURE (1)..(9): Peptide No. 98.0103
VSSIFISFY

SEQ ID NO: 110 - protein, 9 aa, Plasmodium falciparum
  MISC_FEATURE (1)..(9): Peptide No. 98.0104
YSYYEPLRY

SEQ ID NO: 111 - protein, 10 aa, Plasmodium falciparum
  MISC_FEATURE (1)..(10): Peptide No. 98.0017
KSNNIIPLLY

SEQ ID NO: 112 - protein, 9 aa, Plasmodium falciparum
  mi (1)..(9): Peptide No. 98.0105
SSSDEENLY

SEQ ID NO: 113 - protein, 9 aa, Plasmodium falciparum
  MISC_FEATURE (1)..(9): Peptide No. 98.0106
SSDEENLYY

SEQ ID NO: 114 - protein, 9 aa, Plasmodium falciparum
  MISC_FEATURE (1)..(9): Peptide No. 98.0107
KSNMNNNLY

SEQ ID NO: 115 - protein, 9 aa, Plasmodium falciparum
  MISC_FEATURE (1)..(9): Peptide No. 98.0108
FYDKRFIFY

SEQ ID NO: 116 - protein, 10 aa, Plasmodium falciparum
  MISC_FEATURE (1)..(10): Peptide No. 98.0018
NVEKNFLLYY

SEQ ID NO: 117 - protein, 9 aa, Plasmodium falciparum
  MISC_FEATURE (1)..(9): Peptide No. 98.0109
NVEKNFLLY

SEQ ID NO: 118 - protein, 9 aa, Plasmodium falciparum
  MISC_FEATURE (1)..(9): Peptide No. 98.0110
KMDSFLNVY

SEQ ID NO: 119 - protein, 9 aa, Plasmodium falciparum
  MISC_FEATURE (1)..(9): Peptide No. 98.0111
NSLIEFLFY

SEQ ID NO: 120 - protein, 9 aa, Plasmodium falciparum
  MISC_FEATURE (1)..(9): Peptide No. 98.0112
ATYKNGNIY

SEQ ID NO: 121 - protein, 9 aa, Plasmodium falciparum
  MISC_FEATURE (1)..(9): Peptide No. 98.0113
DEEKIFVKY

SEQ ID NO: 122 - protein, 9 aa, Plasmodium falciparum
  MISC_FEATURE (1)..(9): Peptide No. 98.0114
HTSNDSGSY

SEQ ID NO: 123 - protein, 10 aa, Plasmodium falciparum
  MISC_FEATURE (1)..(10): Peptide No. 98.0019
FSFTVGEGKY

SEQ ID NO: 124 - protein, 9 aa, Plasmodium falciparum
  MISC_FEATURE (1)..(9): Peptide No. 98.0115
ETNNNLFIY

SEQ ID NO: 125 - protein, 9 aa, Plasmodium falciparum
  MISC_FEATURE (1)..(9): Peptide No. 98.0116
HVSKHAFEY

SEQ ID NO: 126 - protein, 9 aa, Plasmodium falciparum
  MISC_FEATURE (1)..(9): Peptide No. 98.0117
MSGYSSNNY

SEQ ID NO: 127 - protein, 9 aa, Plasmodium falciparum
  MISC_FEATURE (1)..(9): Peptide No. 98.0118
FMESAFVNY

SEQ ID NO: 128 - protein, 9 aa, Plasmodium falciparum
  MISC_FEATURE (1)..(9): Peptide No. 98.0119
RSPCSHKLY

SEQ ID NO: 129 - protein, 10 aa, Plasmodium falciparum
  MISC_FEATURE (1)..(10): Peptide No. 98.0020
FTGENNIERY

SEQ ID NO: 130 - protein, 9 aa, Plasmodium falciparum
  MISC_FEATURE (1)..(9): Peptide No. 98.0120
NTLMLKADY

SEQ ID NO: 131 - protein, 9 aa, Plasmodium falciparum
  MISC_FEATURE (1)..(9): Peptide No. 98.0121
VSSKPANEY

SEQ ID NO: 132 - protein, 9 aa, Plasmodium falciparum
  MISC_FEATURE (1)..(9): Peptide No. 98.0122
ITYSFTVSY

SEQ ID NO: 133 - protein, 9 aa, Plasmodium falciparum
  MISC_FEATURE (1)..(9): Peptide No. 98.0123
LVETLDNLY

SEQ ID NO: 134 - protein, 9 aa, Plasmodium falciparum
  MISC_FEATURE (1)..(9): Peptide No. 98.0124
ETLDNLYLY

SEQ ID NO: 135 - protein, 9 aa, Plasmodium falciparum
  MISC_FEATURE (1)..(9): Peptide No. 98.0125
LSAKYYISY

SEQ ID NO: 136 - protein, 9 aa, Plasmodium falciparum
  MISC_FEATURE (1)..(9): Peptide No. 98.0126
HSDIHLLNY

SEQ ID NO: 137 - protein, 10 aa, Plasmodium falciparum
  MISC_FEATURE (1)..(10): Peptide No. 98.0021
FTSPVNIKEY

SEQ ID NO: 138 - protein, 9 aa, Plasmodium falciparum
  MISC_FEATURE (1)..(9): Peptide No. 98.0127
YSSYSSPKY

SEQ ID NO: 139 - protein, 9 aa, Plasmodium falciparum
  MISC_FEATURE (1)..(9): Peptide No. 98.0128
GMERNKTKY

SEQ ID NO: 140 - protein, 9 aa, Plasmodium falciparum
  MISC_FEATURE (1)..(9): Peptide No. 98.0129
YSNIDSGKY

SEQ ID NO: 141 - protein, 9 aa, Plasmodium falciparum
  MISC_FEATURE (1)..(9): Peptide No. 98.0130
LIDLSCIHY

SEQ ID NO: 142 - protein, 9 aa, Plasmodium falciparum
  MISC_FEATURE (1)..(9): Peptide No. 98.0131
CSDSSLNIY

SEQ ID NO: 143 - protein, 9 aa, Plasmodium falciparum
  MISC_FEATURE (1)..(9): Peptide No. 98.0132
VSFDNNENY

SEQ ID NO: 144 - protein, 10 aa, Plasmodium falciparum
  MISC_FEATURE (1)..(10): Peptide No. 98.022
YTDIIINIRY

SEQ ID NO: 145 - protein, 10 aa, Plasmodium falciparum
  MISC_FEATURE (1)..(10): Peptide No. 98.0023
LSNIRKPLFY

SEQ ID NO: 146 - protein, 9 aa, Plasmodium falciparum
  MISC_FEATURE (1)..(9): Peptide No. 98.0133
NVDANYCKY

SEQ ID NO: 147 - protein, 9 aa, Plasmodium falciparum
  MISC_FEATURE (1)..(9): Peptide No. 98.0134
CVEKNNMSY

SEQ ID NO: 148 - protein, 9 aa, Plasmodium falciparum
  MISC_FEATURE (1)..(9): Peptide No. 98.0135
SSDGKKSEY

SEQ ID NO: 149 - protein, 9 aa, Plasmodium falciparum
  MISC_FEATURE (1)..(9): Peptide No. 98.0136
RSNNFFFSY

SEQ ID NO: 150 - protein, 10 aa, Plasmodium falciparum
  MISC_FEATURE (1)..(10): Peptide No. 98.0024
FTMVYEKIKY

SEQ ID NO: 151 - protein, 9 aa, Plasmodium falciparum
  MISC_FEATURE (1)..(9): Peptide No. 98.0137
NVDIFLHYY

SEQ ID NO: 152 - protein, 9 aa, Plasmodium falciparum
  MISC_FEATURE (1)..(9): Peptide No. 98.0138
SSNEIHNFY

SEQ ID NO: 153 - protein, 9 aa, Plasmodium falciparum
  MISC_FEATURE (1)..(9): Peptide No. 98.0139
GTKLNRTKY

SEQ ID NO: 154 - protein, 10 aa, Plasmodium falciparum
  MISC_FEATURE (1)..(10): Peptide No. 98.0025
ATVSRAGIVY

SEQ ID NO: 155 - protein, 9 aa, Plasmodium falciparum
  MISC_FEATURE (1)..(9): Peptide No. 98.0140
YTLSSGTKY

SEQ ID NO: 156 - protein, 9 aa, Plasmodium falciparum
  MISC_FEATURE (1)..(9): Peptide No. 98.0141
VSEKEQQLY

SEQ ID NO: 157 - protein, 9 aa, Plasmodium falciparum
  MISC_FEATURE (1)..(9): Peptide No. 98.0142
VVDFERLRY

SEQ ID NO: 158 - protein, 9 aa, Plasmodium falciparum
  MISC_FEATURE (1)..(9): Peptide No. 98.0143
FIDLYKQMY

SEQ ID NO: 159 - protein, 8 aa, Plasmodium falciparum
  MISC_FEATURE (1)..(9): Peptide No. 98.0144
IVDITNVN

SEQ ID NO: 160 - protein, 9 aa, Plasmodium falciparum
  MISC_FEATURE (1)..(9): Peptide No. 98.0145
LEDVKKILY

SEQ ID NO: 161 - protein, 9 aa, Plasmodium falciparum
  MISC_FEATURE (1)..(9): Peptide No. 98.0146
SLDIPDIAY

SEQ ID NO: 162 - protein, 9 aa, Plasmodium falciparum
  MISC_FEATURE (1)..(9): Peptide No. 98.0147
SSCQNSLNY

SEQ ID NO: 163 - protein, 9 aa, Plasmodium falciparum
  MISC_FEATURE (1)..(9): Peptide No. 98.0148
KSDITNLNY

SEQ ID NO: 164 - protein, 9 aa, Plasmodium falciparum
  MISC_FEATURE (1)..(9): Peptide No. 98.0149
ETNNGDLKY

SEQ ID NO: 165 - protein, 9 aa, Plasmodium falciparum
  MISC_FEATURE (1)..(9): Peptide No. 98.0150
LSEDNKNRY

SEQ ID NO: 166 - protein, 10 aa, Plasmodium falciparum
  MISC_FEATURE (1)..(10): Peptide No. 98.0026
LLDLRKNGLY

SEQ ID NO: 167 - protein, 10 aa, Plasmodium falciparum
  MISC_FEATURE (1)..(10): Peptide No. 98.0027
GVDKSLKIMY

SEQ ID NO: 168 - protein, 9 aa, Plasmodium falciparum
  MISC_FEATURE (1)..(9): Peptide No. 98.0151
YTPTNKEMY

SEQ ID NO: 169 - protein, 10 aa, Plasmodium falciparum
  MISC_FEATURE (1)..(10): Peptide No. 98.0028
ESANDSTNYY

SEQ ID NO: 170 - protein, 9 aa, Plasmodium falciparum
  MISC_FEATURE (1)..(9): Peptide No. 98.0152
LSNSITVSY

SEQ ID NO: 171 - protein, 9 aa, Plasmodium falciparum
  MISC_FEATURE (1)..(9): Peptide No. 98.0153
GTTQSNNIY

SEQ ID NO: 172 - protein, 9 aa, Plasmodium falciparum
  MISC_FEATURE (1)..(9): Peptide No. 98.0154
SDDEIIIIY

SEQ ID NO: 173 - protein, 9 aa, Plasmodium falciparum
  MISC_FEATURE (1)..(9): Peptide No. 98.0155
ISSNGKLNY

SEQ ID NO: 174 - protein, 9 aa, Plasmodium falciparum
  MISC_FEATURE (1)..(9): Peptide No. 98.0156
GSIQNAYLY

SEQ ID NO: 175 - protein, 9 aa, Plasmodium falciparum
  MISC_FEATURE (1)..(9): Peptide No. 98.0157
GTMRNRKKY

SEQ ID NO: 176 - protein, 9 aa, Plasmodium falciparum
  MISC_FEATURE (1)..(9): Peptide No. 98.0158
KSLLKNYNY

SEQ ID NO: 177 - protein, 9 aa, Plasmodium falciparum
  MISC_FEATURE (1)..(9): Peptide No. 98.0159
NVEDTNMLY

SEQ ID NO: 178 - protein, 10 aa, Plasmodium falciparum
  MISC_FEATURE (1)..(10): Peptide No. 98.0029
NTDNKDVLNY

SEQ ID NO: 179 - protein, 9 aa, Plasmodium falciparum
  MISC_FEATURE (1)..(9): Peptide No. 98.0160
HTITISQKY

SEQ ID NO: 180 - protein, 9 aa, Plasmodium falciparum
  MISC_FEATURE (1)..(9): Peptide No. 98.0161
ISQKYTSSY

SEQ ID NO: 181 - protein, 10 aa, Plasmodium falciparum
  MISC_FEATURE (1)..(10): Peptide No. 98.0030
KTFHRILAVY

SEQ ID NO: 182 - protein, 9 aa, Plasmodium falciparum
  MISC_FEATURE (1)..(9): Peptide No. 98.0162
KTNGAEERY

SEQ ID NO: 183 - protein, 9 aa, Plasmodium falciparum
  MISC_FEATURE (1)..(9): Peptide No. 98.0163
GTVPTNLDY

SEQ ID NO: 184 - protein, 10 aa, Plasmodium falciparum
  MISC_FEATURE (1)..(10): Peptide No. 98.0031
ESSQNSPKNY

SEQ ID NO: 185 - protein, 10 aa, Plasmodium falciparum
  MISC_FEATURE (1)..(10): Peptide No. 98.0032
QTDFQGWGHY

SEQ ID NO: 186 - protein, 9 aa, Plasmodium falciparum
  MISC_FEATURE (1)..(9): Peptide No. 98.0164
EADFIKKMY

SEQ ID NO: 187 - protein, 9 aa, Plasmodium falciparum
  MISC_FEATURE (1)..(9): Peptide No. 98.0165
ATICRAMKY

SEQ ID NO: 188 - protein, 10 aa, Plasmodium falciparum
  MISC_FEATURE (1)..(10): Peptide No. 98.0033
KTDEQYNENY

SEQ ID NO: 189 - protein, 10 aa, Plasmodium falciparum
  MISC_FEATURE (1)..(10): Peptide No. 98.0034
YTFKNPPPQY

SEQ ID NO: 190 - protein, 9 aa, Plasmodium falciparum
  MISC_FEATURE (1)..(9): Peptide No. 98.0166
WLEYFLDDY

SEQ ID NO: 191 - protein, 9 aa, Plasmodium falciparum
  MISC_FEATURE (1)..(9): Peptide No. 98.0167
ITSSSESEY

SEQ ID NO: 192 - protein, 9 aa, Plasmodium falciparum
  MISC_FEATURE (1)..(9): Peptide No. 98.0168
YVDIGSNIY

SEQ ID NO: 193 - protein, 9 aa, Plasmodium falciparum
  MISC_FEATURE (1)..(9): Peptide No. 98.0169
DTCKNIWNY

SEQ ID NO: 194 - protein, 9 aa, Plasmodium falciparum
  MISC_FEATURE (1)..(9): Peptide No. 98.0170
LSQGKKNTY

SEQ ID NO: 195 - protein, 9 aa, Plasmodium falciparum
  MISC_FEATURE (1)..(9): Peptide No. 98.0171
NIDCVISPY

SEQ ID NO: 196 - protein, 9 aa, Plasmodium falciparum
  MISC_FEATURE (1)..(9): Peptide No.98.0172
NMDNLLFTY

SEQ ID NO: 197 - protein, 10 aa, Plasmodium falciparum
  MISC_FEATURE (1)..(10): Peptide No. 98.0035
FVDHNYNYNY

SEQ ID NO: 198 - protein, 9 aa, Plasmodium falciparum
  MISC_FEATURE (1)..(9): Peptide No. 98.0173
HSKENQQKY

SEQ ID NO: 199 - protein, 9 aa, Plasmodium falciparum
  MISC_FEATURE (1)..(9): Peptide No. 98.0174
VSEGYTSTY

SEQ ID NO: 200 - protein, 9 aa, Plasmodium falciparum
  MISC_FEATURE (1)..(9): Peptide No. 98.0175
FMDSQNGMY

SEQ ID NO: 201 - protein, 10 aa, Plasmodium falciparum
  MISC_FEATURE (1)..(10): Peptide No. 98.0036
NSYNDSLINY

SEQ ID NO: 202 - protein, 9 aa, Plasmodium falciparum
  MISC_FEATURE (1)..(9): Peptide No. 98.0176
STGINEENY

SEQ ID NO: 203 - protein, 9 aa, Plasmodium falciparum
  MISC_FEATURE (1)..(9): Peptide No. 98.0178
MNETVFLDY

SEQ ID NO: 204 - protein, 9 aa, Plasmodium falciparum
  MISC_FEATURE (1)..(9): Peptide No. 98.0178
LTSKVWDTY

SEQ ID NO: 205 - protein, 9 aa, Plasmodium falciparum
  MISC_FEATURE (1)..(9): Peptide No. 98.0179
KHDALTYMY

SEQ ID NO: 206 - protein, 9 aa, Plasmodium falciparum
  MISC_FEATURE (1)..(9): Peptide No. 98.0180
LTYMYCVYY

SEQ ID NO: 207 - protein, 9 aa, Plasmodium falciparum
  MISC_FEATURE (1)..(9): Peptide No. 98.0181
NIDINDLGY

SEQ ID NO: 208 - protein, 9 aa, Plasmodium falciparum
  MISC_FEATURE (1)..(9): Peptide No. 98.0182
ISSNQFNNY

SEQ ID NO: 209 - protein, 9 aa, Plasmodium falciparum
  MISC_FEATURE (1)..(9): Peptide No. 98.0183
DIEPLISSY

SEQ ID NO: 210 - protein, 10 aa, Plasmodium falciparum
  MISC_FEATURE (1)..(10): Peptide No. 98.0037
VTNNDSINNY

SEQ ID NO: 211 - protein, 9 aa, Plasmodium falciparum
  MISC_FEATURE (1)..(9): Peptide No. 98.0184
ESGKNMEHY

SEQ ID NO: 212 - protein, 9 aa, Plasmodium falciparum
  MISC_FEATURE (1)..(9): Peptide No. 98.0185
LKDFDMLLY

SEQ ID NO: 213 - protein, 9 aa, Plasmodium falciparum
  MISC_FEATURE (1)..(9): Peptide No. 98.0186
YIDVEDDDY

SEQ ID NO: 214 - protein, 9 aa, Plasmodium falciparum
  MISC_FEATURE (1)..(9): Peptide No. 98.0187
DMDDNYYLY

SEQ ID NO: 215 - protein, 9 aa, Plasmodium falciparum
  MISC_FEATURE (1)..(9): Peptide No. 98.0188
YGDNNKDCY

SEQ ID NO: 216 - protein, 9 aa, Plasmodium falciparum
  MISC_FEATURE (1)..(9): Peptide No. 98.0189
IYDFNNNSY

SEQ ID NO: 217 - protein, 9 aa, Plasmodium falciparum
  MISC_FEATURE (1)..(9): Peptide No. 98.0206
FYKKKRNVL

SEQ ID NO: 218 - protein, 9 aa, Plasmodium falciparum
  MISC_FEATURE (1)..(9): Peptide No. 98.0207
VYEINKNEF

SEQ ID NO: 219 - protein, 9 aa, Plasmodium falciparum
  MISC_FEATURE (1)..(9): Peptide No. 98.0208
FFVWGHDMF

SEQ ID NO: 220 - protein, 9 aa, Plasmodium falciparum
  MISC_FEATURE (1)..(9): Peptide No. 98.0209
VYNIKENFW

SEQ ID NO: 221 - protein, 9 aa, Plasmodium falciparum
  MISC_FEATURE (1)..(9): Peptide No. 98.0210
KYNLCHNML

SEQ ID NO: 222 - protein, 9 aa, Plasmodium falciparum
  MISC_FEATURE (1)..(9): Peptide No. 98.0211
FYVPIKKKL

SEQ ID NO: 223 - protein, 9 aa, Plasmodium falciparum
  MISC_FEATURE (1)..(9): Peptide No. 98.0212
KYEIIGNIL

SEQ ID NO: 224 - protein, 9 aa, Plasmodium falciparum
  MISC_FEATURE (1)..(9): Peptide No. 98.0213
FWLAIKDIF

SEQ ID NO: 225 - protein, 9 aa, Plasmodium falciparum
  MISC_FEATURE (1)..(9): Peptide No. 98.0214
LYRRRKNLF

SEQ ID NO: 226 - protein, 9 aa, Plasmodium falciparum
  MISC_FEATURE (1)..(9): Peptide No. 98.0215
IYIIKQNSF

SEQ ID NO: 227 - protein, 10 aa, Plasmodium falciparum
  MISC_FEATURE (1)..(10): Peptide No. 98.0190
LFVCFLIFHF

SEQ ID NO: 228 - protein, 10 aa, Plasmodium falciparum
  MISC_FEATURE (1)..(10): Peptide No. 98.0191
CFLIFHFFLF

SEQ ID NO: 229 - protein, 9 aa, Plasmodium falciparum
  MISC_FEATURE (1)..(9): Peptide No. 98.0216
CFLIFHFFL

SEQ ID NO: 230 - protein, 9 aa, Plasmodium falciparum
  MISC_FEATURE (1)..(9): Peptide No. 98.0217
IFHFFLFLL

SEQ ID NO: 231 - protein, 10 aa, Plasmodium falciparum
  MISC_FEATURE (1)..(10): Peptide No. 98.0192
HFFLFLLYIL

SEQ ID NO: 232 - protein, 9 aa, Plasmodium falciparum
  MISC_FEATURE (1)..(9): Peptide No. 98.0218
HFFLFLLYI

SEQ ID NO: 233 - protein, 9 aa, Plasmodium falciparum
  MISC_FEATURE (1)..(9): Peptide No. 98.0219
FFLFLLYIL

SEQ ID NO: 234 - protein, 9 aa, Plasmodium falciparum
  MISC_FEATURE (1)..(9): Peptide No. 98.0220
LYILFLVKM

SEQ ID NO: 235 - protein, 9 aa, Plasmodium falciparum
  MISC_FEATURE (1)..(9): Peptide No. 98.0221
VFLVFSNVL

SEQ ID NO: 236 - protein, 9 aa, Plasmodium falciparum
  MISC_FEATURE (1)..(9): Peptide No. 98.0222
TYGIIVPVL

SEQ ID NO: 237 - protein, 9 aa, Plasmodium falciparum
  MISC_FEATURE (1)..(9): Peptide No. 98.0223
FFNVFNIFF

SEQ ID NO: 238 - protein, 9 aa, Plasmodium falciparum
  MISC_FEATURE (1)..(9): Peptide No. 98.0224
FYSWLQNVL

SEQ ID NO: 239 - protein, 9 aa, Plasmodium falciparum
  MISC_FEATURE (1)..(9): Peptide No. 98.0225
FYERFSDLI

SEQ ID NO: 240 - protein, 9 aa, Plasmodium falciparum
  MISC_FEATURE (1)..(9): Peptide No. 98.0226
VYLIQNNYI

SEQ ID NO: 241 - protein, 9 aa, Plasmodium falciparum
  MISC_FEATURE (1)..(9): Peptide No. 98.0227
NYMKNSFYI

SEQ ID NO: 242 - protein, 9 aa, Plasmodium falciparum
  MISC_FEATURE (1)..(9): Peptide No. 98.0228
VYCNYVTEI

SEQ ID NO: 243 - protein, 9 aa, Plasmodium falciparum
  MISC_FEATURE (1)..(9): Peptide No. 98.0229
HYEVLPYKF

SEQ ID NO: 244 - protein, 9 aa, Plasmodium falciparum
  MISC_FEATURE (1)..(9): Peptide No. 98.0230
KFTIIVESL

SEQ ID NO: 245 - protein, 9 aa, Plasmodium falciparum
  MISC_FEATURE (1)..(9): Peptide No. 98.0231
FMTRAHFHI

SEQ ID NO: 246 - protein, 9 aa, Plasmodium falciparum
  MISC_FEATURE (1)..(9): Peptide No. 98.0232
FYKSKVIII

SEQ ID NO: 247 - protein, 9 aa, Plasmodium falciparum
  MISC_FEATURE (1)..(9): Peptide No. 98.0233
SFLFVEALF

SEQ ID NO: 248 - protein, 9 aa, Plasmodium falciparum
  MISC_FEATURE (1)..(9): Peptide No. 98.0234
YYGKQENWY

SEQ ID NO: 249 - protein, 9 aa, Plasmodium falciparum
  MISC_FEATURE (1)..(9): Peptide No. 98.0235
KMEKCSSVF

SEQ ID NO: 250 - protein, 9 aa, Plasmodium falciparum
  MISC_FEATURE (1)..(9): Peptide No. 98.0236
VFNVVNSSI

SEQ ID NO: 251 - protein, 9 aa, Plasmodium falciparum
  MISC_FEATURE (1)..(9): Peptide No. 98.0237
NYMKIMNHL

SEQ ID NO: 252 - protein, 10 aa, Plasmodium falciparum
  MISC_FEATURE (1)..(10): Peptide No. 98.0193
SYKSSKRDKF

SEQ ID NO: 253 - protein, 9 aa, Plasmodium falciparum
  MISC_FEATURE (1)..(9): Peptide No. 98.0238
TYKKKNNHI

SEQ ID NO: 254 - protein, 9 aa, Plasmodium falciparum
  MISC_FEATURE (1)..(9): Peptide No. 98.0239
VYYNILIVL

SEQ ID NO: 255 - protein, 9 aa, Plasmodium falciparum
  MISC_FEATURE (1)..(9): Peptide No. 98.0240
LYYLFNQHI

SEQ ID NO: 256 - protein, 9 aa, Plasmodium falciparum
  MISC_FEATURE (1)..(9): Peptide No. 98.0241
SFFMNRFYI

SEQ ID NO: 257 - protein, 9 aa, Plasmodium falciparum
  MISC_FEATURE (1)..(9): Peptide No. 98.0242
FYITTRYKY

SEQ ID NO: 258 - protein, 9 aa, Plasmodium falciparum
  MISC_FEATURE (1)..(9): Peptide No. 98.0243
KYINFINFI

SEQ ID NO: 259 - protein, 9 aa, Plasmodium falciparum
  MISC_FEATURE (1)..(9): Peptide No. 98.0244
NFINFIKVL

SEQ ID NO: 260 - protein, 9 aa, Plasmodium falciparum
  MISC_FEATURE (1)..(9): Peptide No. 98.0245
KYEALIKLL

SEQ ID NO: 261 - protein, 9 aa, Plasmodium falciparum
  MISC_FEATURE (1)..(9): Peptide No. 98.0246
FFFSLIDYF

SEQ ID NO: 262 - protein, 9 aa, Plasmodium falciparum
  MISC_FEATURE (1)..(9): Peptide No. 98.0247
KYNIKVCEL

SEQ ID NO: 263 - protein, 9 aa, Plasmodium falciparum
  MISC_FEATURE (1)..(9): Peptide No. 98.0248
FYLYISFLL

SEQ ID NO: 264 - protein, 9 aa, Plasmodium falciparum
  MISC_FEATURE (1)..(9): Peptide No. 98.0249
FYTNNANLL

SEQ ID NO: 265 - protein, 9 aa, Plasmodium falciparum
  MISC_FEATURE (1)..(9): Peptide No. 98.0250
EYNPSFFYL

SEQ ID NO: 266 - protein, 9 aa, Plasmodium falciparum
  MISC_FEATURE (1)..(9): Peptide No. 98.0251
SFIIFKNIF

SEQ ID NO: 267 - protein, 9 aa, Plasmodium falciparum
  MISC_FEATURE (1)..(9): Peptide No. 98.0252
LYMNFLKFI

SEQ ID NO: 268 - protein, 9 aa, Plasmodium falciparum
  MISC_FEATURE (1)..(9): Peptide No. 98.0253
KYLIILLYI

SEQ ID NO: 269 - protein, 9 aa, Plasmodium falciparum
  MISC_FEATURE (1)..(9): Peptide No. 98.0254
KYIYIYIYI

SEQ ID NO: 270 - protein, 9 aa, Plasmodium falciparum
  MISC_FEATURE (1)..(9): Peptide No. 98.0255
IYIYIFIYL

SEQ ID NO: 271 - protein, 9 aa, Plasmodium falciparum
  MISC_FEATURE (1)..(9): Peptide No. 98.0256
IYINKLSFF

SEQ ID NO: 272 - protein, 9 aa, Plasmodium falciparum
  MISC_FEATURE (1)..(9): Peptide No. 98.0257
FFSIKDELF

SEQ ID NO: 273 - protein, 9 aa, Plasmodium falciparum
  MISC_FEATURE (1)..(9): Peptide No. 98.0258
EFLKNNSYF

SEQ ID NO: 274 - protein, 9 aa, Plasmodium falciparum
  MISC_FEATURE (1)..(9): Peptide No. 98.0259
YFNIIQQKI

SEQ ID NO: 275 - protein, 9 aa, Plasmodium falciparum
  MISC_FEATURE (1)..(9): Peptide No. 98.0260
WYCSACNFL

SEQ ID NO: 276 - protein, 9 aa, Plasmodium falciparum
  MISC_FEATURE (1)..(9): Peptide No. 98.0261
LYLINNKNL

SEQ ID NO: 277 - protein, 9 aa, Plasmodium falciparum
  MISC_FEATURE (1)..(9): Peptide No. 98.0262
TYKDANNNI

SEQ ID NO: 278 - protein, 9 aa, Plasmodium falciparum
  MISC_FEATURE (1)..(9): Peptide No. 98.0263
VYEKEKQYF

SEQ ID NO: 279 - protein, 10 aa, Plasmodium falciparum
  MISC_FEATURE (1)..(10): Peptide No. 98.0194
PYFNFFVNYF

SEQ ID NO: 280 - protein, 9 aa, Plasmodium falciparum
  MISC_FEATURE (1)..(9): Peptide No. 98.0264
IYNNNNEHI

SEQ ID NO: 281 - protein, 9 aa, Plasmodium falciparum
  MISC_FEATURE (1)..(9): Peptide No. 98.0265
EYNKYNEYF

SEQ ID NO: 282 - protein, 9 aa, Plasmodium falciparum
  MISC_FEATURE (1)..(9): Peptide No. 98.0266
NYVNNNNVF

SEQ ID NO: 283 - protein, 9 aa, Plasmodium falciparum
  MISC_FEATURE (1)..(9): Peptide No. 98.0267
KYPIKYCEL

SEQ ID NO: 284 - protein, 9 aa, Plasmodium falciparum
  MISC_FEATURE (1)..(9): Peptide No. 98.0268
AYHDLIKLF

SEQ ID NO: 285 - protein, 9 aa, Plasmodium falciparum
  MISC_FEATURE (1)..(9): Peptide No. 98.0269
KYISSVNYF

SEQ ID NO: 286 - protein, 9 aa, Plasmodium falciparum
  MISC_FEATURE (1)..(9): Peptide No. 98.0270
KYDWFFNSF

SEQ ID NO: 287 - protein, 9 aa, Plasmodium falciparum
  MISC_FEATURE (1)..(9): Peptide No. 98.0271
HYVIKKYII

SEQ ID NO: 288 - protein, 9 aa, Plasmodium falciparum
  MISC_FEATURE (1)..(9): Peptide No. 98.0272
LYLHIHKLF

SEQ ID NO: 289 - protein, 9 aa, Plasmodium falciparum
  MISC_FEATURE (1)..(9): Peptide No. 98.0273
YYRTNYGYI

SEQ ID NO: 290 - protein, 9 aa, Plasmodium falciparum
  MISC_FEATURE (1)..(9): Peptide No. 98.0274
KYLRYHSQL

SEQ ID NO: 291 - protein, 9 aa, Plasmodium falciparum
  MISC_FEATURE (1)..(9): Peptide No. 98.0275
FYIDKCIHF

SEQ ID NO: 292 - protein, 9 aa, Plasmodium falciparum
  MISC_FEATURE (1)..(9): Peptide No. 98.0276
FYTNYYQSF

SEQ ID NO: 293 - protein, 9 aa, Plasmodium falciparum
  MISC_FEATURE (1)..(9): Peptide No. 98.0277
PYINQTNIF

SEQ ID NO: 294 - protein, 9 aa, Plasmodium falciparum
  MISC_FEATURE (1)..(9): Peptide No. 98.0278
NYPNNANHI

SEQ ID NO: 295 - protein, 9 aa, Plasmodium falciparum
  MISC_FEATURE (1)..(9): Peptide No. 98.0279
TYNNFHNSY

SEQ ID NO: 296 - protein, 9 aa, Plasmodium falciparum
  MISC_FEATURE (1)..(9): Peptide No. 98.0280
YMNNNTYSF

SEQ ID NO: 297 - protein, 9 aa, Plasmodium falciparum
  MISC_FEATURE (1)..(9): Peptide No. 98.0281
KYTEGATNF

SEQ ID NO: 298 - protein, 9 aa, Plasmodium falciparum
  MISC_FEATURE (1)..(9): Peptide No. 98.0282
FYISIIDII

SEQ ID NO: 299 - protein, 9 aa, Plasmodium falciparum
  MISC_FEATURE (1)..(9): Peptide No. 98.0283
YYKEHISEF

SEQ ID NO: 300 - protein, 9 aa, Plasmodium falciparum
  MISC_FEATURE (1)..(9): Peptide No. 98.0284
YYNRANNEI

SEQ ID NO: 301 - protein, 9 aa, Plasmodium falciparum
  MISC_FEATURE (1)..(9): Peptide No. 98.0285
AFLLITFLM

SEQ ID NO: 302 - protein, 10 aa, Plasmodium falciparum
  MISC_FEATURE (1)..(10): Peptide No. 98.0195
LYVIFLVLLF

SEQ ID NO: 303 - protein, 9 aa, Plasmodium falciparum
  MISC_FEATURE (1)..(9): Peptide No. 98.0286
LYVIFLVLL

SEQ ID NO: 304 - protein, 9 aa, Plasmodium falciparum
  MISC_FEATURE (1)..(9): Peptide No. 98.0287
KYVQLASTY

SEQ ID NO: 305 - protein, 10 aa, Plasmodium falciparum
  MISC_FEATURE (1)..(10): Peptide No. 98.0196
RYQDPQNYEL

SEQ ID NO: 306 - protein, 9 aa, Plasmodium falciparum
  MISC_FEATURE (1)..(9): Peptide No. 98.0288
IYYFDGNSW

SEQ ID NO: 307 - protein, 9 aa, Plasmodium falciparum
  MISC_FEATURE (1)..(9): Peptide No. 98.0289
VYRHCEYIL

SEQ ID NO: 308 - protein, 9 aa, Plasmodium falciparum
  MISC_FEATURE (1)..(9): Peptide No. 98.0290
TWKPTIFLL

SEQ ID NO: 309 - protein, 9 aa, Plasmodium falciparum
  MISC_FEATURE (1)..(9): Peptide No. 98.0291
SYKVNCINF

SEQ ID NO: 310 - protein, 9 aa, Plasmodium falciparum
  MISC_FEATURE (1)..(9): Peptide No. 98.0292
KYNYFIHFF

SEQ ID NO: 311 - protein, 9 aa, Plasmodium falciparum
  MISC_FEATURE (1)..(9): Peptide No. 98.0293
NYFIHFFTW

SEQ ID NO: 312 - protein, 9 aa, Plasmodium falciparum
  MISC_FEATURE (1)..(9): Peptide No. 98.0294
HFFTWGTMF

SEQ ID NO: 313 - protein, 9 aa, Plasmodium falciparum
  MISC_FEATURE (1)..(9): Peptide No. 98.0295
MFVPKYFEL

SEQ ID NO: 314 - protein, 9 aa, Plasmodium falciparum
  MISC_FEATURE (1)..(9): Peptide No. 98.0296
IYTIIQDQL

SEQ ID NO: 315 - protein, 10 aa, Plasmodium falciparum
  MISC_FEATURE (1)..(10): Peptide No. 98.0197
DFFLKSKFNI

SEQ ID NO: 316 - protein, 9 aa, Plasmodium falciparum
  MISC_FEATURE (1)..(9): Peptide No. 98.0297
FFLKSKFNI

SEQ ID NO: 317 - protein, 9 aa, Plasmodium falciparum
  MISC_FEATURE (1)..(9): Peptide No. 98.0298
KFNILSSPL

SEQ ID NO: 318 - protein, 9 aa, Plasmodium falciparum
  MISC_FEATURE (1)..(9): Peptide No. 98.0299
RMTSLKNEL

SEQ ID NO: 319 - protein, 9 aa, Plasmodium falciparum
  MISC_FEATURE (1)..(9): Peptide No. 98.0300
YYNNFNNNY

SEQ ID NO: 320 - protein, 9 aa, Plasmodium falciparum
  MISC_FEATURE (1)..(9): Peptide No. 98.0301
YYNKSTEKL

SEQ ID NO: 321 - protein, 9 aa, Plasmodium falciparum
  MISC_FEATURE (1)..(9): Peptide No. 98.0302
EYEPTANLL

SEQ ID NO: 322 - protein, 9 aa, Plasmodium falciparum
  MISC_FEATURE (1)..(9): Peptide No. 98.0303
PYEEVENYF

SEQ ID NO: 323 - protein, 9 aa, Plasmodium falciparum
  MISC_FEATURE (1)..(9): Peptide No. 98.0304
KFILHMTLL

SEQ ID NO: 324 - protein, 9 aa, Plasmodium falciparum
  MISC_FEATURE (1)..(9): Peptide No. 98.0305
NFLNIYASL

SEQ ID NO: 325 - protein, 9 aa, Plasmodium falciparum
  MISC_FEATURE (1)..(9): Peptide No. 98.0306
VWKKLIEYF

SEQ ID NO: 326 - protein, 9 aa, Plasmodium falciparum
  MISC_FEATURE (1)..(9): Peptide No. 98.0307
LYVSMYIPF

SEQ ID NO: 327 - protein, 9 aa, Plasmodium falciparum
  MISC_FEATURE (1)..(9): Peptide No. 98.0308
MYIPFIKKF

SEQ ID NO: 328 - protein, 9 aa, Plasmodium falciparum
  MISC_FEATURE (1)..(9): Peptide No. 98.0309
KFYDKRFIF

SEQ ID NO: 329 - protein, 9 aa, Plasmodium falciparum
  MISC_FEATURE (1)..(9): Peptide No. 98.0310
IYNMYHNNF

SEQ ID NO: 330 - protein, 9 aa, Plasmodium falciparum
  MISC_FEATURE (1)..(9): Peptide No. 98.0311
MYHNNFSYF

SEQ ID NO: 331 - protein, 9 aa, Plasmodium falciparum
  MISC_FEATURE (1)..(9): Peptide No. 98.0312
KYDITKNLI

SEQ ID NO: 332 - protein, 9 aa, Plasmodium falciparum
  MISC_FEATURE (1)..(9): Peptide No. 98.0313
GYFKRIFKL

SEQ ID NO: 333 - protein, 9 aa, Plasmodium falciparum
  MISC_FEATURE (1)..(9): Peptide No. 98.0314
TYKNGNIYI

SEQ ID NO: 334 - protein, 9 aa, Plasmodium falciparum
  MISC_FEATURE (1)..(9): Peptide No. 98.0315
IYIYIYIYI

SEQ ID NO: 335 - protein, 10 aa, Plasmodium falciparum
  MISC_FEATURE (1)..(10): Peptide No. 98.0198
IYIYIYIYFL

SEQ ID NO: 336 - protein, 9 aa, Plasmodium falciparum
  MISC_FEATURE (1)..(9): Peptide No. 98.0316
IYIYIYIYF

SEQ ID NO: 337 - protein, 9 aa, Plasmodium falciparum
  MISC_FEATURE (1)..(9): Peptide No. 98.0317
IFKNDNNTF

SEQ ID NO: 338 - protein, 9 aa, Plasmodium falciparum
  MISC_FEATURE (1)..(9): Peptide No. 98.0318
KYGNICHHI

SEQ ID NO: 339 - protein, 9 aa, Plasmodium falciparum
  MISC_FEATURE (1)..(9): Peptide No. 98.0319
QYTDIPSLI

SEQ ID NO: 340 - protein, 9 aa, Plasmodium falciparum
  MISC_FEATURE (1)..(9): Peptide No. 98.0320
VFCYEYFIF

SEQ ID NO: 341 - protein, 10 aa, Plasmodium falciparum
  MISC_FEATURE (1)..(10): Peptide No. 98.0199
CYEYFIFDIF

SEQ ID NO: 342 - protein, 9 aa, Plasmodium falciparum
  MISC_FEATURE (1)..(9): Peptide No. 98.0321
CYEYFIFDI

SEQ ID NO: 343 - protein, 9 aa, Plasmodium falciparum
  MISC_FEATURE (1)..(9): Peptide No. 98.0322
KYARNILSL

SEQ ID NO: 344 - protein, 9 aa, Plasmodium falciparum
  MISC_FEATURE (1)..(9): Peptide No. 98.0323
IFVKYLPLF

SEQ ID NO: 345 - protein, 9 aa, Plasmodium falciparum
  MISC_FEATURE (1)..(9): Peptide No. 98.0324
KYLPLFLMM

SEQ ID NO: 346 - protein, 9 aa, Plasmodium falciparum
  MISC_FEATURE (1)..(9): Peptide No. 98.0325
LFLMMEHSF

SEQ ID NO: 347 - protein, 9 aa, Plasmodium falciparum
  MISC_FEATURE (1)..(9): Peptide No. 98.0326
QYSNYFDYL

SEQ ID NO: 348 - protein, 9 aa, Plasmodium falciparum
  MISC_FEATURE (1)..(9): Peptide No. 98.0327
PYETNNNLF

SEQ ID NO: 349 - protein, 9 aa, Plasmodium falciparum
  MISC_FEATURE (1)..(9): Peptide No. 98.0328
YYSRRVEKI

SEQ ID NO: 350 - protein, 9 aa, Plasmodium falciparum
  MISC_FEATURE (1)..(9): Peptide No. 98.0329
KFKWIQDNL

SEQ ID NO: 351 - protein, 10 aa, Plasmodium falciparum
  MISC_FEATURE (1)..(10): Peptide No. 98.0200
RYVGLGSFHF

SEQ ID NO: 352 - protein, 9 aa, Plasmodium falciparum
  MISC_FEATURE (1)..(9): Peptide No. 98.0330
TYKMYPPEF

SEQ ID NO: 353 - protein, 9 aa, Plasmodium falciparum
  MISC_FEATURE (1)..(9): Peptide No. 98.0331
MYPPEFNTL

SEQ ID NO: 354 - protein, 9 aa, Plasmodium falciparum
  MISC_FEATURE (1)..(9): Peptide No. 98.0332
KYCIGSTYF

SEQ ID NO: 355 - protein, 9 aa, Plasmodium falciparum
  MISC_FEATURE (1)..(9): Peptide No. 98.0333
TYFLRQVSI

SEQ ID NO: 356 - protein, 9 aa, Plasmodium falciparum
  MISC_FEATURE (1)..(9): Peptide No. 98.0334
KYSARLHPI

SEQ ID NO: 357 - protein, 9 aa, Plasmodium falciparum
  MISC_FEATURE (1)..(9): Peptide No. 98.0335
FYLKKKFLF

SEQ ID NO: 358 - protein, 9 aa, Plasmodium falciparum
  MISC_FEATURE (1)..(9): Peptide No. 98.0336
KYYISYKVL

SEQ ID NO: 359 - protein, 9 aa, Plasmodium falciparum
  MISC_FEATURE (1)..(9): Peptide No. 98.0337
KYINKNISL

SEQ ID NO: 360 - protein, 9 aa, Plasmodium falciparum
  MISC_FEATURE (1)..(9): Peptide No. 98.0338
KYLKEDNTF

SEQ ID NO: 361 - protein, 9 aa, Plasmodium falciparum
  MISC_FEATURE (1)..(9): Peptide No. 98.0339
KYGDNENNF

SEQ ID NO: 362 - protein, 9 aa, Plasmodium falciparum
  MISC_FEATURE (1)..(9): Peptide No. 98.0340
VFTKINNLF

SEQ ID NO: 363 - protein, 9 aa, Plasmodium falciparum
  MISC_FEATURE (1)..(9): Peptide No. 98.0341
IWLIRSIYL

SEQ ID NO: 364 - protein, 9 aa, Plasmodium falciparum
  MISC_FEATURE (1)..(9): Peptide No. 98.0342
IYLFIITYI

SEQ ID NO: 365 - protein, 9 aa, Plasmodium falciparum
  MISC_FEATURE (1)..(9): Peptide No. 98.0343
FFFVFFYIF

SEQ ID NO: 366 - protein, 9 aa, Plasmodium falciparum
  MISC_FEATURE (1)..(9): Peptide No. 98.0344
FYIFLIYSF

SEQ ID NO: 367 - protein, 9 aa, Plasmodium falciparum
  MISC_FEATURE (1)..(9): Peptide No. 98.0345
MYIFFFILF

SEQ ID NO: 368 - protein, 9 aa, Plasmodium falciparum
  MISC_FEATURE (1)..(9): Peptide No. 98.0346
FYVMSTYTF

SEQ ID NO: 369 - protein, 9 aa, Plasmodium falciparum
  MISC_FEATURE (1)..(9): Peptide No. 98.0347
RYCTKCFLW

SEQ ID NO: 370 - protein, 9 aa, Plasmodium falciparum
  MISC_FEATURE (1)..(9): Peptide No. 98.0348
VYAKNIPLW

SEQ ID NO: 371 - protein, 9 aa, Plasmodium falciparum
  MISC_FEATURE (1)..(9): Peptide No. 98.0349
FFCIFFISL

SEQ ID NO: 372 - protein, 9 aa, Plasmodium falciparum
  MISC_FEATURE (1)..(9): Peptide No. 98.0350
PYYKKKNLF

SEQ ID NO: 373 - protein, 9 aa, Plasmodium falciparum
  MISC_FEATURE (1)..(9): Peptide No. 98.0351
FYTLVNILI

SEQ ID NO: 374 - protein, 9 aa, Plasmodium falciparum
  MISC_FEATURE (1)..(9): Peptide No. 98.0352
YFIIRSYEL

SEQ ID NO: 375 - protein, 9 aa, Plasmodium falciparum
  MISC_FEATURE (1)..(9): Peptide No. 98.0353
KYICLTCAF

SEQ ID NO: 376 - protein, 9 aa, Plasmodium falciparum
  MISC_FEATURE (1)..(9): Peptide No. 98.0354
KYDLFNNFI

SEQ ID NO: 377 - protein, 9 aa, Plasmodium falciparum
  MISC_FEATURE (1)..(9): Peptide No. 98.0355
KYKDMAKIF

SEQ ID NO: 378 - protein, 9 aa, Plasmodium falciparum
  MISC_FEATURE (1)..(9): Peptide No. 98.0356
GYRPFIYSW

SEQ ID NO: 379 - protein, 9 aa, Plasmodium falciparum
  MISC_FEATURE (1)..(9): Peptide No. 98.0357
LYAIFNKLF

SEQ ID NO: 380 - protein, 9 aa, Plasmodium falciparum
  MISC_FEATURE (1)..(9): Peptide No. 98.0358
FYLDKIQIL

SEQ ID NO: 381 - protein, 9 aa, Plasmodium falciparum
  MISC_FEATURE (1)..(9): Peptide No. 98.0359
RMEDKTFSL

SEQ ID NO: 382 - protein, 9 aa, Plasmodium falciparum
  MISC_FEATURE (1)..(9): Peptide No. 98.0360
IYNCVTINW

SEQ ID NO: 383 - protein, 9 aa, Plasmodium falciparum
  MISC_FEATURE (1)..(9): Peptide No. 98.0361
RWTDDSNNF

SEQ ID NO: 384 - protein, 9 aa, Plasmodium falciparum
  MISC_FEATURE (1)..(9): Peptide No. 98.0362
FFYDILNVI

SEQ ID NO: 385 - protein, 9 aa, Plasmodium falciparum
  MISC_FEATURE (1)..(9): Peptide No. 98.0363
KYRKIIYSL

SEQ ID NO: 386 - protein, 9 aa, Plasmodium falciparum
  MISC_FEATURE (1)..(9): Peptide No. 98.0364
KYFIFRIHL

SEQ ID NO: 387 - protein, 9 aa, Plasmodium falciparum
  MISC_FEATURE (1)..(9): Peptide No. 98.0365
KYLTINFFI

SEQ ID NO: 388 - protein, 9 aa, Plasmodium falciparum
  MISC_FEATURE (1)..(9): Peptide No. 98.0366
FFILLTLVF

SEQ ID NO: 389 - protein, 9 aa, Plasmodium falciparum
  MISC_FEATURE (1)..(9): Peptide No. 98.0367
KYSSCQNSL

SEQ ID NO: 390 - protein, 9 aa, Plasmodium falciparum
  MISC_FEATURE (1)..(9): Peptide No. 98.0368
KFIEHINEF

SEQ ID NO: 391 - protein, 9 aa, Plasmodium falciparum
  MISC_FEATURE (1)..(9): Peptide No. 98.0369
KYIELNDLI

SEQ ID NO: 392 - protein, 9 aa, Plasmodium falciparum
  MISC_FEATURE (1)..(9): Peptide No. 98.0370
PYSNVTYVI

SEQ ID NO: 393 - protein, 9 aa, Plasmodium falciparum
  MISC_FEATURE (1)..(9): Peptide No. 98.0371
MYDILNAYF

SEQ ID NO: 394 - protein, 9 aa, Plasmodium falciparum
  MISC_FEATURE (1)..(9): Peptide No. 98.0372
HYIMNNTIF

SEQ ID NO: 395 - protein, 9 aa, Plasmodium falciparum
  MISC_FEATURE (1)..(9): Peptide No. 98.0373
FFKYIISYF

SEQ ID NO: 396 - protein, 9 aa, Plasmodium falciparum
  MISC_FEATURE (1)..(9): Peptide No. 98.0374
KYLNDDNYL

SEQ ID NO: 397 - protein, 9 aa, Plasmodium falciparum
  MISC_FEATURE (1)..(9): Peptide No. 98.0375
LYKSIFKAF

SEQ ID NO: 398 - protein, 9 aa, Plasmodium falciparum
  MISC_FEATURE (1)..(9): Peptide No. 98.0376
SYRIVNAGF

SEQ ID NO: 399 - protein, 9 aa, Plasmodium falciparum
  MISC_FEATURE (1)..(9): Peptide No. 98.0377
KYTFRSLSI

SEQ ID NO: 400 - protein, 9 aa, Plasmodium falciparum
  MISC_FEATURE (1)..(9): Peptide No. 98.0378
KYKNDSNRI

SEQ ID NO: 401 - protein, 9 aa, Plasmodium falciparum
  MISC_FEATURE (1)..(9): Peptide No. 98.0379
SYIYNKNIF

SEQ ID NO: 402 - protein, 9 aa, Plasmodium falciparum
  MISC_FEATURE (1)..(9): Peptide No. 98.0380
FMKNNTTLF

SEQ ID NO: 403 - protein, 9 aa, Plasmodium falciparum
  MISC_FEATURE (1)..(9): Peptide No. 98.0381
HYVMINNNL

SEQ ID NO: 404 - protein, 9 aa, Plasmodium falciparum
  MISC_FEATURE (1)..(9): Peptide No. 98.0382
FFLFFSIFI

SEQ ID NO: 405 - protein, 9 aa, Plasmodium falciparum
  MISC_FEATURE (1)..(9): Peptide No. 98.0383
RYFLHTITI

SEQ ID NO: 406 - protein, 9 aa, Plasmodium falciparum
  MISC_FEATURE (1)..(9): Peptide No. 98.0384
KYTSSYDSL

SEQ ID NO: 407 - protein, 9 aa, Plasmodium falciparum
  MISC_FEATURE (1)..(9): Peptide No. 98.0385
YYKLREDWW

SEQ ID NO: 408 - protein, 9 aa, Plasmodium falciparum
  MISC_FEATURE (1)..(9): Peptide No. 98.0386
QYLRWFEEW

SEQ ID NO: 409 - protein, 9 aa, Plasmodium falciparum
  MISC_FEATURE (1)..(9): Peptide No. 98.0387
HWTQIKKHF

SEQ ID NO: 410 - protein, 9 aa, Plasmodium falciparum
  MISC_FEATURE (1)..(9): Peptide No. 98.0388
HYFVLETVL

SEQ ID NO: 411 - protein, 9 aa, Plasmodium falciparum
  MISC_FEATURE (1)..(9): Peptide No. 98.0389
RWMDTAGFI

SEQ ID NO: 412 - protein, 10 aa, Plasmodium falciparum
  MISC_FEATURE (1)..(10): Peptide No. 98.0201
IYMPPRRQHF

SEQ ID NO: 413 - protein, 9 aa, Plasmodium falciparum
  MISC_FEATURE (1)..(9): Peptide No. 98.0390
RWMTEWAEW

SEQ ID NO: 414 - protein, 9 aa, Plasmodium falciparum
  MISC_FEATURE (1)..(9): Peptide No. 98.0391
KYQYDKVKL

SEQ ID NO: 415 - protein, 9 aa, Plasmodium falciparum
  MISC_FEATURE (1)..(9): Peptide No. 98.0392
KYCRFYKRW

SEQ ID NO: 416 - protein, 9 aa, Plasmodium falciparum
  MISC_FEATURE (1)..(9): Peptide No. 98.0392
YFLDDYNKI

SEQ ID NO: 417 - protein, 9 aa, Plasmodium falciparum
  MISC_FEATURE (1)..(9): Peptide No. 98.0394
KYELRKTSI

SEQ ID NO: 418 - protein, 9 aa, Plasmodium falciparum
  MISC_FEATURE (1)..(9): Peptide No. 98.0395
MYKNKVDPL

SEQ ID NO: 419 - protein, 9 aa, Plasmodium falciparum
  MISC_FEATURE (1)..(9): Peptide No. 98.0396
YYDTCKNIW

SEQ ID NO: 420 - protein, 9 aa, Plasmodium falciparum
  MISC_FEATURE (1)..(9): Peptide No. 98.0397
KYINNMSFI

SEQ ID NO: 421 - protein, 9 aa, Plasmodium falciparum
  MISC_FEATURE (1)..(9): Peptide No. 98.0398
LYPWKENKF

SEQ ID NO: 422 - protein, 9 aa, Plasmodium falciparum
  MISC_FEATURE (1)..(9): Peptide No. 98.0399
KWNVFNNSI

SEQ ID NO: 423 - protein, 9 aa, Plasmodium falciparum
  MISC_FEATURE (1)..(9): Peptide No. 98.0400
KFKIINSYI

SEQ ID NO: 424 - protein, 9 aa, Plasmodium falciparum
NYAYDNIEL

SEQ ID NO: 425 - protein, 9 aa, Plasmodium falciparum
  MISC_FEATURE (1)..(9): Peptide No. 98.0402
IYTSTNNII

SEQ ID NO: 426 - protein, 9 aa, Plasmodium falciparum
  MISC_FEATURE (1)..(9): Peptide No. 98.0403
KYTYNINNL

SEQ ID NO: 427 - protein, 10 aa, Plasmodium falciparum
  MISC_FEATURE (1)..(9): Peptide No. 98.0202
RYNVINHIYL

SEQ ID NO: 428 - protein, 9 aa, Plasmodium falciparum
  MISC_FEATURE (1)..(9): Peptide No. 98.0404
RYNVINHIY

SEQ ID NO: 429 - protein, 9 aa, Plasmodium falciparum
  MISC_FEATURE (1)..(9): Peptide No. 98.0405
TYNYLTPTL

SEQ ID NO: 430 - protein, 10 aa, Plasmodium falciparum
  MISC_FEATURE (1)..(10): Peptide No. 98.0203
RFRVFKDYSF

SEQ ID NO: 431 - protein, 9 aa, Plasmodium falciparum
  MISC_FEATURE (1)..(9): Peptide No. 98.0406
VFKDYSFFI

SEQ ID NO: 432 - protein, 9 aa, Plasmodium falciparum
  MISC_FEATURE (1)..(9): Peptide No. 98.0407
FFIDEVKKI

SEQ ID NO: 433 - protein, 9 aa, Plasmodium falciparum
  MISC_FEATURE (1)..(9): Peptide No. 98.0408
VYYDNYESL

SEQ ID NO: 434 - protein, 9 aa, Plasmodium falciparum
  MISC_FEATURE (1)..(9): Peptide No. 98.0409
RFVEKIYYL

SEQ ID NO: 435 - protein, 9 aa, Plasmodium falciparum
  MISC_FEATURE (1)..(9): Peptide No. 98.0410
IYINVQKNL

SEQ ID NO: 436 - protein, 9 aa, Plasmodium falciparum
  MISC_FEATURE (1)..(9): Peptide No. 98.0411
KFYYYFKEF

SEQ ID NO: 437 - protein, 10 aa, Plasmodium falciparum
  MISC_FEATURE (1)..(10): Peptide No. 98.0204
FYYYFKEFLL

SEQ ID NO: 438 - protein, 9 aa, Plasmodium falciparum
  MISC_FEATURE (1)..(9): Peptide No. 98.0412
FYYYFKEFL

SEQ ID NO: 439 - protein, 9 aa, Plasmodium falciparum
  MISC_FEATURE (1)..(9): Peptide No. 98.0413
TYIPDKKLL

SEQ ID NO: 440 - protein, 9 aa, Plasmodium falciparum
  MISC_FEATURE (1)..(9): Peptide No. 98.0414
NYLYNKYYI

SEQ ID NO: 441 - protein, 9 aa, Plasmodium falciparum
  MISC_FEATURE (1)..(9): Peptide No. 98.0415
NFKEQHLLF

SEQ ID NO: 442 - protein, 9 aa, Plasmodium falciparum
  MISC_FEATURE (1)..(9): Peptide No. 98.0416
HYINNKHNL

SEQ ID NO: 443 - protein, 9 aa, Plasmodium falciparum
  MISC_FEATURE (1)..(9): Peptide No. 98.0417
LYREHSREL

SEQ ID NO: 444 - protein, 9 aa, Plasmodium falciparum
  MISC_FEATURE (1)..(9): Peptide No. 98.0418
NYINNNIYL

SEQ ID NO: 445 - protein, 9 aa, Plasmodium falciparum
  MISC_FEATURE (1)..(9): Peptide No. 98.0419
NYNQKENSF

SEQ ID NO: 446 - protein, 10 aa, Plasmodium falciparum
  MISC_FEATURE (1)..(10): Peptide No. 98.0205
QYKVKIKPVF

SEQ ID NO: 447 - protein, 9 aa, Plasmodium falciparum
  MISC_FEATURE (1)..(9): Peptide No. 99.0042
LIYPCVYEI

SEQ ID NO: 448 - protein, 9 aa, Plasmodium falciparum
  MISC_FEATURE (1)..(9): Peptide No. 99.0043
NMNVQNFFV

SEQ ID NO: 449 - protein, 9 aa, Plasmodium falciparum
  MISC_FEATURE (1)..(9): Peptide No. 99.0044
FVWGHDMFM

SEQ ID NO: 450 - protein, 9 aa, Plasmodium falciparum
  MISC_FEATURE (1)..(9): Peptide No. 99.0045
QLDDKFAFI

SEQ ID NO: 451 - protein, 9 aa, Plasmodium falciparum
  MISC_FEATURE (1)..(9): Peptide No. 99.0046
CLINHNFFM

SEQ ID NO: 452 - protein, 9 aa, Plasmodium falciparum
  MISC_FEATURE (1)..(9): Peptide No. 99.0047
FMLVGGINI

SEQ ID NO: 453 - protein, 9 aa, Plasmodium falciparum
  MISC_FEATURE (1)..(9): Peptide No. 99.0048
YIIGGGCTV

SEQ ID NO: 454 - protein, 9 aa, Plasmodium falciparum
  MISC_FEATURE (1)..(9): Peptide No. 99.0049
FTFGSFFDV

SEQ ID NO: 455 - protein, 9 aa, Plasmodium falciparum
  MISC_FEATURE (1)..(9): Peptide No. 99.0050
NLSFAQYTL

SEQ ID NO: 456 - protein, 9 aa, Plasmodium falciparum
  MISC_FEATURE (1)..(9): Peptide No. 99.0051
RMYHYVVDI

SEQ ID NO: 457 - protein, 10 aa, Plasmodium falciparum
  MISC_FEATURE (1)..(10): Peptide No. 99.0001
VLRLFVCFLI

SEQ ID NO: 458 - protein, 10 aa, Plasmodium falciparum
  MISC_FEATURE (1)..(10): Peptide No. 99.0002
FLIFHFFLFL

SEQ ID NO: 459 - protein, 10 aa, Plasmodium falciparum
  MISC_FEATURE (1)..(10): Peptide No. 99.0003
LIFHFFLFLL

SEQ ID NO: 460 - protein, 10 aa, Plasmodium falciparum
  MISC_FEATURE (1)..(10): Peptide No. 99.0004
FLFLLYILFL

SEQ ID NO: 461 - protein, 10 aa, Plasmodium falciparum
  MISC_FEATURE (1)..(10): Peptide No. 99.0005
RLPVICSFLV

SEQ ID NO: 462 - protein, 10 aa, Plasmodium falciparum
  MISC_FEATURE (1)..(10): Peptide No. 99.0006
VICSFLVFLV

SEQ ID NO: 463 - protein, 10 aa, Plasmodium falciparum
  MISC_FEATURE (1)..(10): Peptide No. 99.0007
FLVFLVFSNV

SEQ ID NO: 464 - protein, 9 aa, Plasmodium falciparum
  MISC_FEATURE (1)..(9): Peptide No. 99.0052
LIFHFFLFL

SEQ ID NO: 465 - protein, 9 aa, Plasmodium falciparum
  MISC_FEATURE (1)..(9): Peptide No. 99.0053
FLLYILFLV

SEQ ID NO: 466 - protein, 9 aa, Plasmodium falciparum
  MISC_FEATURE (1)..(9): Peptide No. 99.0054
VICSFLVFL

SEQ ID NO: 467 - protein, 9 aa, Plasmodium falciparum
  MISC_FEATURE (1)..(9): Peptide No. 99.0055
ATYGIIVPV

SEQ ID NO: 468 - protein, 10 aa, Plasmodium falciparum
  MISC_FEATURE (1)..(10): Peptide No. 99.0008
FLYAFNKYYV

SEQ ID NO: 469 - protein, 9 aa, Plasmodium falciparum
  MISC_FEATURE (1)..(9): Peptide No. 99.0056
NMISVVYYI

SEQ ID NO: 470 - protein, 9 aa, Plasmodium falciparum
  MISC_FEATURE (1)..(9): Peptide No. 99.0057
SLCFYFLLL

SEQ ID NO: 471 - protein, 9 aa, Plasmodium falciparum
  MISC_FEATURE (1)..(9): Peptide No. 99.0058
ILFLHNYLL

SEQ ID NO: 472 - protein, 9 aa, Plasmodium falciparum
  MISC_FEATURE (1)..(9): Peptide No. 99.0059
YLDVYNFLL

SEQ ID NO: 473 - protein, 9 aa, Plasmodium falciparum
  MISC_FEATURE (1)..(9): Peptide No. 99.0060
FQLYYMYYL

SEQ ID NO: 474 - protein, 9 aa, Plasmodium falciparum
  MISC_FEATURE (1)..(9): Peptide No. 99.0061
YVMDKVLRL

SEQ ID NO: 475 - protein, 9 aa, Plasmodium falciparum
  MISC_FEATURE (1)..(9): Peptide No. 99.0062
LLFILSHFI

SEQ ID NO: 476 - protein, 9 aa, Plasmodium falciparum
  MISC_FEATURE (1)..(9): Peptide No. 99.0063
YLVNYCLVV

SEQ ID NO: 477 - protein, 9 aa, Plasmodium falciparum
  MISC_FEATURE (1)..(9): Peptide No. 99.0064
KIYVCIYYL

SEQ ID NO: 478 - protein, 10 aa, Plasmodium falciparum
  MISC_FEATURE (1)..(10): Peptide No. 99.0009
ILSVSSFLFV

SEQ ID NO: 479 - protein, 10 aa, Plasmodium falciparum
  MISC_FEATURE (1)..(10): Peptide No. 99.0010
LIMVLSFLFL

SEQ ID NO: 480 - protein, 9 aa, Plasmodium falciparum
  MISC_FEATURE (1)..(9): Peptide No. 99.0065
YLNKIQNSL

SEQ ID NO: 481 - protein, 9 aa, Plasmodium falciparum
  MISC_FEATURE (1)..(9): Peptide No. 99.0066
IMVLSFLFL

SEQ ID NO: 482 - protein, 10 aa, Plasmodium falciparum
  MISC_FEATURE (1)..(10): Peptide No. 99.0011
VQMMIMIKFM

SEQ ID NO: 483 - protein, 10 aa, Plasmodium falciparum
  MISC_FEATURE (1)..(10): Peptide No. 99.0012
MMIMIKFMGV

SEQ ID NO: 484 - protein, 9 aa, Plasmodium falciparum
  MISC_FEATURE (1)..(9): Peptide No. 99.0067
KIYKIIIWI

SEQ ID NO: 485 - protein, 9 aa, Plasmodium falciparum
  MISC_FEATURE (1)..(9): Peptide No. 99.0068
YMIKKLLKI

SEQ ID NO: 486 - protein, 9 aa, Plasmodium falciparum
  MISC_FEATURE (1)..(9): Peptide No. 99.0069
LMTLYQIQV

SEQ ID NO: 487 - protein, 9 aa, Plasmodium falciparum
  MISC_FEATURE (1)..(9): Peptide No. 99.0070
FMGVIYIMI

SEQ ID NO: 488 - protein, 9 aa, Plasmodium falciparum
  MISC_FEATURE (1)..(9): Peptide No. 99.0071
NILIVLYYL

SEQ ID NO: 489 - protein, 9 aa, Plasmodium falciparum
  MISC_FEATURE (1)..(9): Peptide No. 99.0072
FMNRFYITT

SEQ ID NO: 490 - protein, 10 aa, Plasmodium falciparum
  MISC_FEATURE (1)..(10): Peptide No. 99.0013
YLYISFLLLI

SEQ ID NO: 491 - protein, 10 aa, Plasmodium falciparum
  MISC_FEATURE (1)..(10): Peptide No. 99.0014
YIYIFIYLFI

SEQ ID NO: 492 - protein, 9 aa, Plasmodium falciparum
  MISC_FEATURE (1)..(9): Peptide No. 99.0073
LLDDYHFET

SEQ ID NO: 493 - protein, 9 aa, Plasmodium falciparum
  MISC_FEATURE (1)..(9): Peptide No. 99.0074
YLYISFLLL

SEQ ID NO: 494 - protein, 9 aa, Plasmodium falciparum
  MISC_FEATURE (1)..(9): Peptide No. 99.0075
FLTLTVYPI

SEQ ID NO: 495 - protein, 9 aa, Plasmodium falciparum
  MISC_FEATURE (1)..(9): Peptide No. 99.0076
FIIEILELL

SEQ ID NO: 496 - protein, 9 aa, Plasmodium falciparum
  MISC_FEATURE (1)..(9): Peptide No. 99.0077
LLYNHITSI

SEQ ID NO: 497 - protein, 9 aa, Plasmodium falciparum
  MISC_FEATURE (1)..(9): Peptide No. 99.0078
YMNFLKFIV

SEQ ID NO: 498 - protein, 9 aa, Plasmodium falciparum
  MISC_FEATURE (1)..(9): Peptide No. 99.0079
FIYIWLHLI

SEQ ID NO: 499 - protein, 9 aa, Plasmodium falciparum
  MISC_FEATURE (1)..(9): Peptide No. 99.0080
HLIIIFIFV

SEQ ID NO: 500 - protein, 10 aa, Plasmodium falciparum
  MISC_FEATURE (1)..(10): Peptide No. 99.0015
FLMWSSQIII

SEQ ID NO: 501 - protein, 9 aa, Plasmodium falciparum
  MISC_FEATURE (1)..(9): Peptide No. 99.0081
ILLSRFIFI

SEQ ID NO: 502 - protein, 9 aa, Plasmodium falciparum
  MISC_FEATURE (1)..(9): Peptide No. 99.0082
YLNFQDNYL

SEQ ID NO: 503 - protein, 9 aa, Plasmodium falciparum
  MISC_FEATURE (1)..(9): Peptide No. 99.0083
NIPYFNFFV

SEQ ID NO: 504 - protein, 9 aa, Plasmodium falciparum
  MISC_FEATURE (1)..(9): Peptide No. 99.0084
FVNYFEAVV

SEQ ID NO: 505 - protein, 9 aa, Plasmodium falciparum
  MISC_FEATURE (1)..(9): Peptide No. 99.0085
NIHCYTYFL

SEQ ID NO: 506 - protein, 9 aa, Plasmodium falciparum
  MISC_FEATURE (1)..(9): Peptide No. 99.0086
FLMWSSQII

SEQ ID NO: 507 - protein, 9 aa, Plasmodium falciparum
  MISC_FEATURE (1)..(9): Peptide No. 99.0087
LMWSSQIII

SEQ ID NO: 508 - protein, 9 aa, Plasmodium falciparum
  MISC_FEATURE (1)..(9): Peptide No. 99.0088
ILNKISSFV

SEQ ID NO: 509 - protein, 9 aa, Plasmodium falciparum
  MISC_FEATURE (1)..(9): Peptide No. 99.0089
FVFFIIKNV

SEQ ID NO: 510 - protein, 9 aa, Plasmodium falciparum
  MISC_FEATURE (1)..(9): Peptide No. 99.0090
IQICKLYHV

SEQ ID NO: 511 - protein, 9 aa, Plasmodium falciparum
  MISC_FEATURE (1)..(9): Peptide No. 99.0091
YISSVNYFL

SEQ ID NO: 512 - protein, 9 aa, Plasmodium falciparum
  MISC_FEATURE (1)..(9): Peptide No. 99.0092
YLFQLVQSL

SEQ ID NO: 513 - protein, 9 aa, Plasmodium falciparum
  MISC_FEATURE (1)..(9): Peptide No. 99.0093
SIYFYWFLL

SEQ ID NO: 514 - protein, 9 aa, Plasmodium falciparum
  MISC_FEATURE (1)..(9): Peptide No. 99.0094
YLHIHKLFI

SEQ ID NO: 515 - protein, 9 aa, Plasmodium falciparum
  MISC_FEATURE (1)..(9): Peptide No. 99.0095
ILDDSINFV

SEQ ID NO: 516 - protein, 9 aa, Plasmodium falciparum
  MISC_FEATURE (1)..(9): Peptide No. 99.0096
FLPEQSYVL

SEQ ID NO: 517 - protein, 9 aa, Plasmodium falciparum
  MISC_FEATURE (1)..(9): Peptide No. 99.0097
HLVIQIIYV

SEQ ID NO: 518 - protein, 9 aa, Plasmodium falciparum
  MISC_FEATURE (1)..(9): Peptide No. 99.0098
FLSVINASV

SEQ ID NO: 519 - protein, 10 aa, Plasmodium falciparum
  MISC_FEATURE (1)..(10): Peptide No. 99.0016
ILYPSLMPYV

SEQ ID NO: 520 - protein, 10 aa, Plasmodium falciparum
  MISC_FEATURE (1)..(10): Peptide No. 99.0017
YLFGKVKFYI

SEQ ID NO: 521 - protein, 9 aa, Plasmodium falciparum
  MISC_FEATURE (1)..(9): Peptide No. 99.0099
KLINTNFYI

SEQ ID NO: 522 - protein, 9 aa, Plasmodim falciparum
  MISC_FEATURE (1)..(9): Peptide No. 99.0100
KTFIYSNFL

SEQ ID NO: 523 - protein, 9 aa, Plasmodium falciparum
  MISC_FEATURE (1)..(9): Peptide No. 99.0101
SLMPYVECI

SEQ ID NO: 524 - protein, 9 aa, Plasmodium falciparum
  MISC_FEATURE (1)..(9): Peptide No. 99.0102
YTNYYQSFI

SEQ ID NO: 525 - protein, 9 aa, Plasmodium falciparum
  MISC_FEATURE (1)..(9): Peptide No. 99.0103
FQWEKSNKI

SEQ ID NO: 526 - protein, 9 aa, Plasmodium falciparum
  MISC_FEATURE (1)..(9): Peptide No. 99.0104
FLIKLNNEI

SEQ ID NO: 527 - protein, 9 aa, Plasmodium falciparum
  MISC_FEATURE (1)..(9): Peptide No. 99.0105
YMYTNYLNM

SEQ ID NO: 528 - protein, 9 aa, Plasmodium falciparum
  MISC_FEATURE (1)..(9): Peptide No. 99.0106
FQGEYVSNL

SEQ ID NO: 529 - protein, 10 aa, Plasmodium falciparum
  MISC_FEATURE (1)..(10): Peptide No. 99.0018
ILILIDAASV

SEQ ID NO: 530 - protein, 10 aa, Plasmodium falciparum
  MISC_FEATURE (1)..(10): Peptide No. 99.0019
LLITFLMINL

SEQ ID NO: 531 - protein, 10 aa, Plasmodium falciparum
  MISC_FEATURE (1)..(10): Peptide No. 99.0020
ALVVAIILYV

SEQ ID NO: 532 - protein, 10 aa, Plasmodium falciparum
  MISC_FEATURE (1)..(10): Peptide No. 99.0021
AIILYVIFLV

SEQ ID NO: 533 - protein, 10 aa, Plasmodium falciparum
  MISC_FEATURE (1)..(10): Peptide No. 99.0022
ILYVIFLVLL

SEQ ID NO: 534 - protein, 10 aa, Plasmodium falciparum
  MISC_FEATURE (1)..(10): Peptide No. 99.0023
YVIFLVLLFI

SEQ ID NO: 535 - protein, 10 aa, Plasmodium falciparum
  MISC_FEATURE (1)..(10): Peptide No. 99.0024
FLVLLFIYKA

SEQ ID NO: 536 - protein, 9 aa, Plasmodium falciparum
  MISC_FEATURE (1)..(9): Peptide No. 99.0107
FLLITFLMI

SEQ ID NO: 537 - protein, 9 aa, Plasmodium falciparum
  MISC_FEATURE (1)..(9): Peptide No. 99.0108
LVVAIILYV

SEQ ID NO: 538 - protein, 9 aa, Plasmodium falciparum
  MISC_FEATURE (1)..(9): Peptide No. 99.0109
AIILYVIFL

SEQ ID NO: 539 - protein, 9 aa, Plasmodium falciparum
  MISC_FEATURE (1)..(9): Peptide No. 99.0110
IILYVIFLV

SEQ ID NO: 540 - protein, 9 aa, Plasmodium falciparum
  MISC_FEATURE (1)..(9): Peptide No. 99.0111
ILYVIFLVL

SEQ ID NO: 541 - protein, 9 aa, Plasmodium falciparum
  MISC_FEATURE (1)..(9): Peptide No. 99.0112
VIFLVLLFI

SEQ ID NO: 542 - protein, 9 aa, Plasmodium falciparum
  MISC_FEATURE (1)..(9): Peptide No. 99.0113
YQDPQNYEL

SEQ ID NO: 543 - protein, 9 aa, Plasmodium falciparum
  MISC_FEATURE (1)..(9): Peptide No. 99.0114
KTWKPTIFL

SEQ ID NO: 544 - protein, 9 aa, Plasmodium falciparum
  MISC_FEATURE (1)..(9): Peptide No. 99.0015
LLNESNIFL

SEQ ID NO: 545 - protein, 9 aa, Plasmodium falciparum
  MISC_FEATURE (1)..(9): Peptide No. 99.0116
FIHFFTWGT

SEQ ID NO: 546 - protein, 9 aa, Plasmodium falciparum
  MISC_FEATURE (1)..(9): Peptide No. 99.0117
VLFLQMMNV

SEQ ID NO: 547 - protein, 9 aa, Plasmodium falciparum
  MISC_FEATURE (1)..(9): Peptide No. 99.0118
NQMIFVSSI

SEQ ID NO: 548 - protein, 9 aa, Plasmodium falciparum
  MISC_FEATURE (1)..(9): Peptide No. 99.0119
MIFVSSIFI

SEQ ID NO: 549 - protein, 9 aa, Plasmodium falciparum
  MISC_FEATURE (1)..(9): Peptide No. 99.0120
SIFISFYLI

SEQ ID NO: 550 - protein, 9 aa, Plasmodium falciparum
  MISC_FEATURE (1)..(9): Peptide No. 99.0121
RLFEESLGI

SEQ ID NO: 551 - protein, 10 aa, Plasmodium falciparum
  MISC_FEATURE (1)..(10): Peptide No. 99.0025
YLCLYNGLLL

SEQ ID NO: 552 - protein, 10 aa, Plamsodium falciparum
  MISC_FEATURE (1)..(10): Peptide No. 99.0026
YLLFFREKFL

SEQ ID NO: 553 - protein, 9 aa, Plasmodium falciparum
  MISC_FEATURE (1)..(9): Peptide No. 99.0122
KLIEYFLNM

SEQ ID NO: 554 - protein, 9 aa, Plasmodium falciparum
  MISC_FEATURE (1)..(9): Peptide No. 99.0123
YVSMYIPFI

SEQ ID NO: 555 - protein, 9 aa, Plasmodium falciparum
  MISC_FEATURE (1)..(9): Peptide No. 99.0124
YLCLYNGLL

SEQ ID NO: 556 - protein, 9 aa, Plasmodium falciparum
  MISC_FEATURE (1)..(9): Peptide No. 99.0125
NIISSIFYI

SEQ ID NO: 557 - protein, 9 aa, Plasmodium falciparum
  MISC_FEATURE (1)..(9): Peptide No. 99.0126
YLYDNYSHL

SEQ ID NO: 558 - protein, 9 aa, Plasmodium falciparum
  MISC_FEATURE (1)..(9): Peptide No. 99.0127
FLNVYENFL

SEQ ID NO: 559 - protein, 9 aa, Plasmodium falciparum
  MISC_FEATURE (1)..(9): Peptide No. 99.0128
LIFGYNSLI

SEQ ID NO: 560 - protein, 9 aa, Plasmodium falciparum
  MISC_FEATURE (1)..(9): Peptide No. 99.0129
FLFYGCREV

SEQ ID NO: 561 - protein, 9 aa, Plasmodium falciparum
  MISC_FEATURE (1)..(9): Peptide No. 99.0130
YIYIYIYFL

SEQ ID NO: 562 - protein, 9 aa, Plasmodium falciparum
  MISC_FEATURE (1)..(9): Peptide No. 99.0131
YIYIYFLQI

SEQ ID NO: 563 - protein, 9 aa, Plasmodium falciparum
  MISC_FEATURE (1)..(9): Peptide No. 99.0132
KQYTDIPSL

SEQ ID NO: 564 - protein, 9 aa, Plasmodium falciparum
  MISC_FEATURE (1)..(9): Peptide No. 99.0133
KVFCYEYFI

SEQ ID NO: 565 - protein, 9 aa, Plasmodium falciparum
  MISC_FEATURE (1)..(9): Peptide No. 99.0134
FIFDIFKYA

SEQ ID NO: 566 - protein, 10 aa, Plasmodium falciparum
  MISC_FEATURE (1)..(10): Peptide No. 99.0027
ALLSFLVVLV

SEQ ID NO: 567 - protein, 10 aa, Plasmodium falciparum
  MISC_FEATURE (1)..(10): Peptide No. 99.0028
RQINFMETFV

SEQ ID NO: 568 - protein, 9 aa, Plasmodium falciparum
  MISC_FEATURE (1)..(9): Peptide No. 99.0135
FVALLSFLV

SEQ ID NO: 569 - protein, 9 aa, Plasmodium falciparum
  MISC_FEATURE (1)..(9): Peptide No. 99.0136
LLSFLVVLV

SEQ ID NO: 570 - protein, 9 aa, Plasmodium falciparum
  MISC_FEATURE (1)..(9): Peptide No. 99.0137
FIYNWVLQT

SEQ ID NO: 571 - protein, 9 aa, Plasmodium falciparum
  MISC_FEATURE (1)..(9): Peptide No. 99.0138
ILIRALLSL

SEQ ID NO: 572 - protein, 9 aa, Plasmodium falciparum
  MISC_FEATURE (1)..(9): Peptide No. 99.0139
ALLSLDFSL

SEQ ID NO: 573 - protein, 9 aa, Plasmodium falciparum
  MISC_FEATURE (1)..(9): Peptide No. 99.0140
NLFGGGFYI

SEQ ID NO: 574 - protein, 9 aa, Plasmodium falciparum
  MISC_FEATURE (1)..(9): Peptide No. 99.0141
LMLKADYFI

SEQ ID NO: 575 - protein, 9 aa, Plasmodium falciparum
  MISC_FEATURE (1)..(9): Peptide No. 99.0142
NIYTHSVYV

SEQ ID NO: 576 - protein, 9 aa, Plasmodium falciparum
  MISC_FEATURE (1)..(9): Peptide No. 99.0143
FVLACVLLI

SEQ ID NO: 577 - protein, 9 aa, Plasmodium falciparum
  MISC_FEATURE (1)..(9): Peptide No. 99.0144
ATSTFFFFL

SEQ ID NO: 578 - protein, 9 aa, Plasmodium falciparum
  MISC_FEATURE (1)..(9): Peptide No. 99.0145
FLLICGFCI

SEQ ID NO: 579 - protein, 9 aa, Plasmodium falciparum
  MISC_FEATURE (1)..(9): Peptide No. 99.0146
VLITYSFTV

SEQ ID NO: 580 - protein, 9 aa, Plasmodium falciparum
  MISC_FEATURE (1)..(9): Peptide No. 99.0147
FTVSYIFFM

SEQ ID NO: 581 - protein, 9 aa, Plasmodium falciparum
  MISC_FEATURE (1)..(9): Peptide No. 99.0148
LLVCISILL

SEQ ID NO: 582 - protein, 9 aa, Plasmodium falciparum
  MISC_FEATURE (1)..(9): Peptide No. 99.0149
FIITYIWII

SEQ ID NO: 583 - protein, 9 aa, Plasmodium falciparum
  MISC_FEATURE (1)..(9): Peptide No. 99.0150
KMMWTIFIL

SEQ ID NO: 584 - protein, 9 aa, Plasmodium falciparum
  MISC_FEATURE (1)..(9): Peptide No. 99.0151
FVFFYIFLI

SEQ ID NO: 585 - protein, 9 aa, Plasmodium falciparum
  MISC_FEATURE (1)..(9): Peptide No. 99.0152
YLDRIQFLV

SEQ ID NO: 586 - protein, 10 aa, Plasmodium falciparum
  MISC_FEATURE (1)..(10): Peptide No. 99.0029
VLSPFSLIFV

SEQ ID NO: 587 - protein, 10 aa, Plasmodium falciparum
  MISC_FEATURE (1)..(10): Peptide No. 99.0030
TLVNILILFL

SEQ ID NO: 588 - protein, 10 aa, Plasmodium falciparum
  MISC_FEATURE (1)..(10): Peptide No. 99.0031
FVFFRFLFFV

SEQ ID NO: 589 - protein, 9 aa, Plasmodium falciparum
  MISC_FEATURE (1)..(9): Peptide No. 99.0153
FILFYFYVM

SEQ ID NO: 590 - protein, 9 aa, Plasmodium falciparum
  MISC_FEATURE (1)..(9): Peptide No. 99.0154
YTFCFLPVL

SEQ ID NO: 591 - protein, 9 aa, Plasmodium falciparum
  MISC_FEATURE (1)..(9): Peptide No. 99.0155
WLFFFDLVV

SEQ ID NO: 592 - protein, 9 aa, Plasmodium falciparum
  MISC_FEATURE (1)..(9): Peptide No. 99.0156
HLFFCIFFI

SEQ ID NO: 593 - protein, 9 aa, Plasmodium falciparum
  MISC_FEATURE (1)..(9): Peptide No. 99.0157
ILFLICYSI

SEQ ID NO: 594 - protein, 9 aa, Plasmodium falciparum
  MISC_FEATURE (1)..(9): Peptide No. 99.0158
YMFSYIPFV

SEQ ID NO: 595 - protein, 9 aa, Plasmodium falciparum
  MISC_FEATURE (1)..(9): Peptide No. 99.0159
YILFILFFI

SEQ ID NO: 596 - protein, 9 aa, Plasmodium falciparum
  MISC_FEATURE (1)..(10): Peptide No. 99.0032
YILFILFFI

SEQ ID NO: 597 - protein, 9 aa, Plasmodium falciparum
  MISC_FEATURE (1)..(9): Peptide No. 99.0160
FVSFYKFEV

SEQ ID NO: 598 - protein, 9 aa, Plasmodium falciparum
  MISC_FEATURE (1)..(9): Peptide No. 99.0161
MLWCSMESV

SEQ ID NO: 599 - protein, 9 aa, Plasmodium falciparum
  MISC_FEATURE (1)..(9): Peptide No. 99.0162
KLFDAINYL

SEQ ID NO: 600 - protein, 9 aa, Plasmodium falciparum
  MISC_FEATURE (1)..(9): Peptide No. 99.0163
FVMDITDSI

SEQ ID NO: 601 - protein, 9 aa, Plasmodium falciparum
  MISC_FEATURE (1)..(9): Peptide No. 99.0164
MLYSIVWGL

SEQ ID NO: 602 - protein, 9 aa, Plasmodium falciparum
  MISC_FEATURE (1)..(9): Peptide No. 99.0165
NIYFSYFYV

SEQ ID NO: 603 - protein, 9 aa, Plasmodium falciparum
  MISC_FEATURE (1)..(9): Peptide No. 99.0166
FILEHVNSI

SEQ ID NO: 604 - protein, 9 aa, Plasmodium falciparum
  MISC_FEATURE (1)..(9): Peptide No. 99.0167
SLLKAQLFV

SEQ ID NO: 605 - protein, 9 aa, Plasmodium falciparum
  MISC_FEATURE (1)..(9): Peptide No. 99.0168
SLDEVVLYT

SEQ ID NO: 606 - protein, 10 aa, Plasmodium falciparum
  MISC_FEATURE (1)..(10): Peptide No. 99.0033
HLMHIINVFI

SEQ ID NO: 607 - protein, 10 aa, Plasmodium falciparum
  MISC_FEATURE (1)..(10): Peptide No. 99.0034
FLSDYTTCSV

SEQ ID NO: 608 - protein, 10 aa, Plasmodium falciparum
  MISC_FEATURE (1)..(10): Peptide No. 99.0035
FLRNYVVIFI

SEQ ID NO: 609 - protein, 9 aa, Plasmodium falciparum
  MISC_FEATURE (1)..(9): Peptide No. 99.0169
YLTINFFIL

SEQ ID NO: 610 - protein, 9 aa, Plasmodium falciparum
  MISC_FEATURE (1)..(9): Peptide No. 99.0170
NMNDIENFV

SEQ ID NO: 611 - protein, 9 aa, Plasmodium falciparum
  MISC_FEATURE (1)..(9): Peptide No. 99.0171
FIHDILLDL

SEQ ID NO: 612 - protein, 9 aa, Plasmodium falciparum
  MISC_FEATURE (1)..(9): Peptide No. 99.0172
NQYAYDLKI

SEQ ID NO: 613 - protein, 9 aa, Plasmodium falciparum
  MISC_FEATURE (1)..(9): Peptide No. 99.0173
GLGGLLFII

SEQ ID NO: 614 - protein, 9 aa, Plasmodium falciparum
  MISC_FEATURE (1)..(9): Peptide No. 99.0174
YIMNNTIFT

SEQ ID NO: 615 - protein, 9 aa, Plasmodium falciparum
  MISC_FEATURE (1)..(9): Peptide No. 99.0175
HLFNFSNFV

SEQ ID NO: 616 - protein, 10 aa, Plasmodium falciparum
  MISC_FEATURE (1)..(10): Peptide No. 99.0036
YLIRNILMSI

SEQ ID NO: 617 - protein, 9 aa, Plasmodium falciparum
  MISC_FEATURE (1)..(9): Peptide No. 99.0176
YLYKSIFKA

SEQ ID NO: 618 - protein, 9 aa, Plasmodium falciparum
  MISC_FEATURE (1)..(9): Peptide No. 99.0177
YLDFYEFCV

SEQ ID NO: 619 - protein, 9 aa, Plasmodium falciparum
  MISC_FEATURE (1)..(9): Peptide No. 99.0178
KIFFLFFSI

SEQ ID NO: 620 - protein, 9 aa, Plasmodium falciparum
  MISC_FEATURE (1)..(9): Peptide No. 99.0179
KLNEINILL

SEQ ID NO: 621 - protein, 10 aa, Plasmodium falciparum
  MISC_FEATURE (1)..(10): Peptide No. 99.0037
FLMFWVAHML

SEQ ID NO: 622 - protein, 9 aa, Plasmodium falciparum
  MISC_FEATURE (1)..(9): Peptide No. 99.0180
LLAEVCYAA

SEQ ID NO: 623 - protein, 9 aa, Plasmodium falciparum
  MISC_FEATURE (1)..(9): Peptide No. 99.0181
CLYVCDPYV

SEQ ID NO: 624 - protein, 9 aa, Plasmodium falciparum
  MISC_FEATURE (1)..(9): Peptide No. 99.0182
FLMFWVAHM

SEQ ID NO: 625 - protein, 9 aa, Plasmodium falciparum
  MISC_FEATURE (1)..(9): Peptide No. 99.0183
FQGWGHYFV

SEQ ID NO: 626 - protein, 9 aa, Plasmodium falciparum
  MISC_FEATURE (1)..(9): Peptide No. 99.0184
FLGDVLFAA

SEQ ID NO: 627 - protein, 9 aa, Plasmodium falciparum
  MISC_FEATURE (1)..(9): Peptide No. 99.0185
VLFAANYEA

SEQ ID NO: 628 - protein, 9 aa, Plasmodium falciparum
  MISC_FEATURE (1)..(9): Peptide No. 99.0186
YLQAQTTAA

SEQ ID NO: 629 - protein, 9 aa, Plasmodium falciparum
  MISC_FEATURE (1)..(9): Peptide No. 99.0187
FLRQMFYTL

SEQ ID NO: 630 - protein, 9 aa, Plasmodium falciparum
  MISC_FEATURE (1)..(9): Peptide No. 99.0188
FAAFTYFYL

SEQ ID NO: 631 - protein, 10 aa, Plasmodium falciparum
  MISC_FEATURE (1)..(10): Peptide No. 99.0038
FMDSQNGMYI

SEQ ID NO: 632 - protein, 10 aa, Plasmodium falciparum
  MISC_FEATURE (1)..(10): Peptide No. 99.0039
SLINYNKYFV

SEQ ID NO: 633 - protein, 9 aa, Plasmodium falciparum
  MISC_FEATURE (1)..(9): Peptide No. 99.0189
FVVAQLYEL

SEQ ID NO: 634 - protein, 9 aa, Plasmodium falciparum
  MISC_FEATURE (1)..(9): Peptide No. 99.0190
KTFFFFSNV

SEQ ID NO: 635 - protein, 9 aa, Plasmodium falciparum
  MISC_FEATURE (1)..(9): Peptide No. 99.0191
IINSDDYFV

SEQ ID NO: 636 - protein, 9 aa, Plasmodium falciparum
  MISC_FEATURE (1)..(9): Peptide No. 99.0192
GMYILPQYV

SEQ ID NO: 637 - protein, 10 aa, Plasmodium falciparum
  MISC_FEATURE (1)..(10): Peptide No. 99.0040
ELVEFIFLLL

SEQ ID NO: 638 - protein, 10 aa, Plasmodium falciparum
  MISC_FEATURE (1)..(10): Peptide No. 99.0041
FLYKDVLMDI

SEQ ID NO: 639 - protein, 9 aa, Plasmodium falciparum
  MISC_FEATURE (1)..(9): Peptide No. 99.0193
ELVEFIFLL

SEQ ID NO: 640 - protein, 9 aa, Plasmodium falciparum
  MISC_FEATURE (1)..(9): Peptide No. 99.0194
YLNKANPNI

SEQ ID NO: 641 - protein, 9 aa, Plasmodium falciparum
  MISC_FEATURE (1)..(9): Peptide No. 99.0195
FLQYRIPHM

SEQ ID NO: 642 - protein, 9 aa, Plasmodium falciparum
YIVDIFCKI

SEQ ID NO: 643 - protein, 10 aa, Plasmodium falciparum
  MISC_FEATURE (1)..(10): Peptide No. 99.0197
KFEPFIIHVK

SEQ ID NO: 644 - protein, 9 aa, Plasmodium falciparum
  MISC_FEATURE (1)..(9): Peptide No. 99.0294
KTMDTFYKK

SEQ ID NO: 645 - protein, 9 aa, Plasmodium falciparum
  MISC_FEATURE (1)..(9): Peptide No. 99.0295
SFFDVSKKK

SEQ ID NO: 646 - protein, 9 aa, Plasmodium falciparum
  MISC_FEATURE (1)..(9): Peptide No. 99.0296
LSQLVHFYK

SEQ ID NO: 647 - protein, 9 aa, Plasmodium falciparum
  MISC_FEATURE (1)..(9): Peptide No. 99.0297
SVFVRRYIK

SEQ ID NO: 648 - protein, 9 aa, Plasmodium falciparum
  MISC_FEATURE (1)..(9): Peptide No. 99.0298
FTFQNMYVR

SEQ ID NO: 649 - protein, 9 aa, Plasmodium falciparum
  MISC_FEATURE (1)..(9): Peptide No. 99.0299
SQNSNTFLK

SEQ ID NO: 650 - protein, 9 aa, Plasmodium falciparum
  MISC_FEATURE (1)..(9): Peptide No. 9.0300
ILFHKFLNK

SEQ ID NO: 651 - protein, 9 aa, Plasmodium falciparum
  MISC_FEATURE (1)..(9): Peptide No. 99.0301
NLFDENFCR

SEQ ID NO: 652 - protein, 9 aa, Plasmodium falciparum
  MISC_FEATURE (1)..(9): Peptide No. 99.0302
ALYEKVHGK

SEQ ID NO: 653 - protein, 10 aa, Plasmodium falciparum
  MISC_FEATURE (1)..(10): Peptide No. 99.0198
FLLYILFLVK

SEQ ID NO: 654 - protein, 10 aa, Plasmodium falciparum
  MISC_FEATURE (1)..(10): Peptide No. 99.0199
LVFSNVLCFR

SEQ ID NO: 655 - protein, 10 aa, Plasmodium falciparum
  MISC_FEATURE (1)..(10): Peptide No. 99.0200
AFLESQSMNK

SEQ ID NO: 656 - protein, 10 aa, Plasmodium falciparum
  MISC_FEATURE (1)..(10): Peptide No. 99.0201
TFLESSFDIK

SEQ ID NO: 657 - protein, 10 aa, Plasmodium falciparum
  MISC_FEATURE (1)..(10): Peptide No. 99.0202
SSFDIKSEVK

SEQ ID NO: 658 - protein, 9 aa, Plasmodium falciparum
  MISC_FEATURE (1)..(9): Peptide No. 99.0303
LLYILFLVK

SEQ ID NO: 659 - protein, 9 aa, Plasmodium falciparum
  MISC_FEATURE (1)..(9): Peptide No. 99.0304
KSMLKELIK

SEQ ID NO: 660 - protein, 9 aa, Plasmodium falciparum
  MISC_FEATURE (1)..(9): Peptide No. 99.0305
PVLTSLFNK

SEQ ID NO: 661 - protein, 10 aa, Plasmodium falciparum
  MISC_FEATURE (1)..(10): Peptide No. 99.0203
TFICYYVMDK

SEQ ID NO: 662 - protein, 9 aa, Plasmodium falciparum
  MISC_FEATURE (1)..(9): Peptide No. 99.0306
NVFNIFFEK

SEQ ID NO: 663 - protein, 9 aa, Plasmodium falciparum
  MISC_FEATURE (1)..(9): Peptide No. 99.0307
SSFLYAFNK

SEQ ID NO: 664 - protein, 9 aa, Plasmodium falciparum
  MISC_FEATURE (1)..(9): Peptide No. 99.0308
MFHIIMYTK

SEQ ID NO: 665 - protein, 9 aa, Plasmodium falciparum
  MISC_FEATURE (1)..(9): Peptide No. 99.0309
SLDDIYKYK

SEQ ID NO: 666 - protein, 9 aa, Plasmodium falciparum
  MISC_FEATURE (1)..(9): Peptide No. 99.0310
KVVVKNLYK

SEQ ID NO: 667 - protein, 9 aa, Plasmodium falciparum
  MISC_FEATURE (1)..(9): Peptide No. 99.0311
SLFRLGFVK

SEQ ID NO: 668 - protein, 9 aa, Plasmodium falciparum
  MISC_FEATURE (1)..(9): Peptide No. 99.0312
SLFRLGFVK

SEQ ID NO: 669 - protein, 9 aa, Plasmodium falciparum
  MISC_FEATURE (1)..(9): Peptide No. 99.0313
ITFEKNYYR

SEQ ID NO: 670 - protein, 9 aa, Plasmodium falciparum
  MISC_FEATURE (1)..(9): Peptide No. 99.0314
SQYEENKSK

SEQ ID NO: 671 - protein, 10 aa, Plasmodium falciparum
  MISC_FEATURE (1)..(10): Peptide No. 99.0204
KQENWYSLKK

SEQ ID NO: 672 - protein, 10 aa, Plasmodium falciparum
  MISC_FEATURE (1)..(10): Peptide No. 99.0205
VTCGNGIQVR

SEQ ID NO: 673 - protein, 9 aa, Plasmodium falciparum
  MISC_FEATURE (1)..(9): Peptide No. 99.0315
ALFQEYQCY

SEQ ID NO: 674 - protein, 9 aa, Plasmodium falciparum
  MISC_FEATURE (1)..(9): Peptide No. 99.0316
KQENWYSLK

SEQ ID NO: 675 - protein, 10 aa, Plasmodium falciparum
  MISC_FEATURE (1)..(10): Peptide No. 99.0206
TLYQIQVMKR

SEQ ID NO: 676 - protein, 10 aa, Plasmodium falciparum
  MISC_FEATURE (1)..(10): Peptide No. 99.0207
KQVQMMIMIK

SEQ ID NO: 677 - protein, 10 aa, Plasmodium falciparum
  MISC_FEATURE (1)..(10): Peptide No. 99.0208
GVIYIMIISK

SEQ ID NO: 678 - protein, 10 aa, Plasmodium falciparum
  MISC_FEATURE (1)..(10): Peptide No. 99.0209
ELFDKDTFFK

SEQ ID NO: 679 - protein, 9 aa, Plasmodium falciparum
  MISC_FEATURE (1)..(9): Peptide No. 99.0317
KTMNNYMIK

SEQ ID NO: 680 - protein, 9 aa, Plasmodium falciparum
  MISC_FEATURE (1)..(9): Peptide No. 99.0318
LFDKDTFFK

SEQ ID NO: 681 - protein, 9 aa, Plasmodium falciparum
  MISC_FEATURE (1)..(9): Peptide No. 99.0319
YLFNQHIKK

SEQ ID NO: 682 - protein, 9 aa, Plasmodium falciparum
  MISC_FEATURE (1)..(9): Peptide No. 99.0320
MQSSFFMNR

SEQ ID NO: 683 - protein, 9 aa, Plasmodium falciparum
  MISC_FEATURE (1)..(9): Peptide No. 99.0321
RFYITTRYK

SEQ ID NO: 684 - protein, 9 aa, Plasmodium falciparum
  MISC_FEATURE (1)..(9): Peptide No. 99.0322
TTRYKYLNK

SEQ ID NO: 685 - protein, 10 aa, Plasmodium falciparum
  MISC_FEATURE (1)..(10): Peptide No. 99.0210
KVCELLGYYK

SEQ ID NO: 686 - protein, 10 aa, Plasmodium falciparum
  MISC_FEATURE (1)..(10): Peptide No. 99.0211
SFLLLIVFSK

SEQ ID NO: 687 - protein, 10 aa, Plasmodium falciparum
  MISC_FEATURE (1)..(10): Peptide No. 99.0212
KLLYKMNYLK

SEQ ID NO: 688 - protein, 10 aa, Plasmodium falciparum
  MISC_FEATURE (1)..(10): Peptide No. 99.0213
TLEYNPSFFY

SEQ ID NO: 689 - protein, 10 aa, Plasmodium falciparum
  MISC_FEATURE (1)..(10): Peptide No. 99.0214
LLYNHITSIK

SEQ ID NO: 690 - protein, 10 aa, Plasmodium falciparum
  MISC_FEATURE (1)..(10): Peptide No. 99.0215
LFYLYMNFLK

SEQ ID NO: 691 - protein, 9 aa, Plasmodium falciparum
  MISC_FEATURE (1)..(9): Peptide No. 99.0323
KQNIPIYIY

SEQ ID NO: 692 - protein, 9 aa, Plasmodium falciparum
  MISC_FEATURE (1)..(9): Peptide No. 99.0324
KTNIFFKKK

SEQ ID NO: 693 - protein, 9 aa, Plasmodium falciparum
  MISC_FEATURE (1)..(9): Peptide No. 99.0325
IVNDLGIFY

SEQ ID NO: 694 - protein, 9 aa, Plasmodium falciparum
  MISC_FEATURE (1)..(9): Peptide No. 99.0326
PSFFYLSFK

SEQ ID NO: 695 - protein, 10 aa, Plasmodium falciparum
  MISC_FEATURE (1)..(10): Peptide No. 99.0216
ILLIRPMLVK

SEQ ID NO: 696 - protein, 10 aa, Plasmodium falciparum
  MISC_FEATURE (1)..(10): Peptide No. 99.0217
LVKLRPMLVK

SEQ ID NO: 697 - protein, 10 aa, Plasmodium falciparum
  MISC_FEATURE (1)..(10): Peptide No. 99.0218
LVKLRPMLVK

SEQ ID NO: 698 - protein, 9 aa, Plasmodium falciparum
  MISC_FEATURE (1)..(9): Peptide No. 99.0327
LLIRPMLVK

SEQ ID NO: 699 - protein, 10 aa, Plasmodium falciparum
  MISC_FEATURE (1)..(10): Peptide No. 99.0219
LLSRFIFIYK

SEQ ID NO: 700 - protein, 10 aa, Plasmodium falciparum
  MISC_FEATURE (1)..(10): Peptide No. 99.0220
KTSDAKLVDK

SEQ ID NO: 701 - protein, 10 aa, Plasmodium falciparum
  MISC_FEATURE (1)..(10): Peptide No. 99.0221
ETSTISTFIK

SEQ ID NO: 702 - protein, 10 aa, Plasmodium falciparum
  MISC_FEATURE (1)..(10): Peptide No. 99.0222
IFFSYNPFHK

SEQ ID NO: 703 - protein, 10 aa, Plasmodium falciparum
  MISC_FEATURE (1)..(10): Peptide No. 99.0223
YFFNCIQMAK

SEQ ID NO: 704 - protein, 9 aa, Plasmodium falciparum
  MISC_FEATURE (1)..(9): Peptide No. 99.0328
SLYNKIEYR

SEQ ID NO: 705 - protein, 9 aa, Plasmodium falciparum
  MISC_FEATURE (1)..(9): Peptide No. 00.0329
SASESNFYK

SEQ ID NO: 706 - protein, 9 aa, Plasmodium falciparum
  MISC_FEATURE (1)..(9): Peptide No. 99.0330
ISYIFPLFK

SEQ ID NO: 707 - protein, 9 aa, Plasmodium falciparum
  MISC_FEATURE (1)..(9): Peptide No. 99.0331
SQNYENINK

SEQ ID NO: 708 - protein, 9 aa, Plasmodium falciparum
  MISC_FEATURE (1)..(9): Peptide No. 99.0332
SLMDASKNK

SEQ ID NO: 709 - protein, 9 aa, Plasmodium falciparum
  MISC_FEATURE (1)..(9): Peptide No. 99.0333
KLGFFVCYK

SEQ ID NO: 710 - protein, 9 aa, Plasmodium falciparum
  MISC_FEATURE (1)..(9): Peptide No. 99.0334
SFKNKILQK

SEQ ID NO: 711 - protein, 9 aa, Plasmodium falciparum
  MISC_FEATURE (1)..(9): Peptide No. 99.0335
KFMYLRKKK

SEQ ID NO: 712 - protein, 9 aa, Plasmodium falciparum
  MISC_FEATURE (1)..(9): Peptide No. 99.0336
KQIIFEALK

SEQ ID NO: 713 - protein, 9 aa, Plasmodium falciparum
  MISC_FEATURE (1)..(9): Peptide No. 99.0337
ETFYKELYK

SEQ ID NO: 714 - protein, 9 aa, Plasmodium falciparum
  MISC_FEATURE (1)..(9): Peptide No. 99.0338
SVNYFLLER

SEQ ID NO: 715 - protein, 9 aa, Plasmodium falciparum
  MISC_FEATURE (1)..(9): Peptide No. 99.0339
ILNFLNFNK

SEQ ID NO: 716 - protein, 9 aa, Plasmodium falciparum
  MISC_FEATURE (1)..(9): Peptide No. 99.0340
NTCSKEIYK

SEQ ID NO: 717 - protein, 9 aa, Plasmodium falciparum
  MISC_FEATURE (1)..(9): Peptide No. 99.0341
KLRNFLFYY

SEQ ID NO: 718 - protein, 9 aa, Plasmodium falciparum
  MISC_FEATURE (1)..(9): Peptide No. 99.0342
CSNNNIFYK

SEQ ID NO: 719 - protein, 10 aa, Plasmodium falciparum
  MISC_FEATURE (1)..(10): Peptide No. 99.0224
MQYNHDNIYK

SEQ ID NO: 720 - protein, 10 aa, Plasmodium falciparum
  MISC_FEATURE (1)..(10): Peptide No. 99.0225
SFSMLYLFGK

SEQ ID NO: 721 - protein, 9 aa, Plasmodium falciparum
  MISC_FEATURE (1)..(9): Peptide No. 99.0343
ALNPKYQNH

SEQ ID NO: 722 - protein, 9 aa, Plasmodium falciparum
  MISC_FEATURE (1)..(9): Peptide No. 99.0344
TLNSFQHNK

SEQ ID NO: 723 - protein, 9 aa, Plasmodium falciparum
  MISC_FEATURE (1)..(9): Peptide No. 99.0345
KINEFQWEK

SEQ ID NO: 724 - protein, 9 aa, Plasmodium falciparum
  MISC_FEATURE (1)..(9): Peptide No. 99.0346
RSDYFHNTK

SEQ ID NO: 725 - protein, 9 aa, Plasmodium falciparum
  MISC_FEATURE (1)..(9): Peptide No. 99.0347
STNSQQLIK

SEQ ID NO: 726 - protein, 9 aa, Plasmodium falciparum
  MISC_FEATURE (1)..(9): Peptide No. 99.0348
KFMTPTTLK

SEQ ID NO: 727 - protein, 9 aa, Plasmodium falciparum
  MISC_FEATURE (1)..(9): Peptide No. 99.0349
TTNSTPHFK

SEQ ID NO: 728 - protein, 9 aa, Plasmodium falciparum
  MISC_FEATURE (1)..(9): Peptide No. 99.0350
KLMETRFSK

SEQ ID NO: 729 - protein, 10 aa, Plasmodium falciparum
  MISC_FEATURE (1)..(10): Peptide No. 99.0226
SQAHRENGKK

SEQ ID NO: 730 - protein, 10 aa, Plasmodium falciparum
  MISC_FEATURE (1)..(10): Peptide No. 99.0227
KALVVAIILY

SEQ ID NO: 731 - protein, 10 aa, Plasmodium falciparum
  MISC_FEATURE (1)..(10): Peptide No. 99.0228
VIFLVLLFIY

SEQ ID NO: 732 - protein, 10 aa, Plasmodium falciparum
  MISC_FEATURE (1)..(10): Peptide No. 99.0229
IFLVLLFIYK

SEQ ID NO: 733 - protein, 10 aa, Plasmodium falciparum
  MISC_FEATURE (1)..(10): Peptide No. 99.0230
LVLLFIYKAY

SEQ ID NO: 734 - protein, 10 aa, Plasmodium falciparum
  MISC_FEATURE (1)..(10): Peptide No. 99.0231
VLLFIYKAYK

SEQ ID NO: 735 - protein, 10 aa, Plasmodium falciparum
  MISC_FEATURE (1)..(10): Peptide No. 99.0232
LFIYKAYKNK

SEQ ID NO: 736 - protein, 10 aa, Plasmodium falciparum
  MISC_FEATURE (1)..(10): Peptide No. 99.0233
KLYTNFFMKK

SEQ ID NO: 737 - protein, 10 aa, Plasmodium falciparum
  MISC_FEATURE (1)..(10): Peptide No. 99.0234
STYLSASDEY

SEQ ID NO: 738 - protein, 9 aa, Plasmodium falciparum
  MISC_FEATURE (1)..(9): Peptide No. 99.0351
SQAHRENGK

SEQ ID NO: 739 - protein, 9 aa, Plasmodium falciparum
  MISC_FEATURE (1)..(9): Peptide No. 99.0352
ALVVAIILY

SEQ ID NO: 740 - protein, 9 aa, Plasmodium falciparum
  MISC_FEATURE (1)..(9): Peptide No. 99.0353
FLVLLFIYK

SEQ ID NO: 741 - protein, 9 aa, Plasmodium falciparum
  MISC_FEATURE (1)..(9): Peptide No. 99.0354
LVLLFIYKA

SEQ ID NO: 742 - protein, 9 aa, Plasmodium falciparum
  MISC_FEATURE (1)..(9): Peptide No. 99.0355
LLFIYKAYK

SEQ ID NO: 743 - protein, 9 aa, Plasmodium falciparum
  MISC_FEATURE (1)..(9): Peptide No. 99.0356
FIYKAYKNK

SEQ ID NO: 744 - protein, 9 aa, Plasmodium falciparum
  MISC_FEATURE (1)..(9): Peptide No. 99.0357
KLYTNFFMK

SEQ ID NO: 745 - protein, 9 aa, Plasmodium falciparum
  MISC_FEATURE (1)..(9): Peptide No. 99.0358
YTNFFMKKR

SEQ ID NO: 746 - protein, 10 aa, Plasmodium falciparum
  MISC_FEATURE (1)..(10): Peptide No. 99.0235
ALERLLSLKK

SEQ ID NO: 747 - protein, 10 aa, Plasmodium falciparum
  MISC_FEATURE (1)..(10): Peptide No. 99.0236
KILIKIPVTK

SEQ ID NO: 748 - protein, 10 aa, Plasmodium falciparum
  MISC_FEATURE (1)..(10): Peptide No. 99.0237
RLPLLPKTWK

SEQ ID NO: 749 - protein, 10 aa, Plasmodium falciparum
  MISC_FEATURE (1)..(10): Peptide No. 99.0238
NIFLRFIPDK

SEQ ID NO: 750 - protein, 10 aa, Plasmodium falciparum
  MISC_FEATURE (1)..(10): Peptide No. 99.0239
NIFLRFIPDK

SEQ ID NO: 751 - protein, 10 aa, Plasmodium falciparum
  MISC_FEATURE (1)..(10): Peptide No. 99.0240
QQNQESKIMK

SEQ ID NO: 752 - protein, 10 aa, Plasmodium falciparum
  MISC_FEATURE (1)..(10): Peptide No. 99.0241
IIALLIIPPK

SEQ ID NO: 753 - protein, 10 aa, Plasmodium falciparum
  MISC_FEATURE (1)..(10): Peptide No. 99.0242
SQDLACIFDA

SEQ ID NO: 754 - protein, 9 aa, Plasmodium falciparum
  MISC_FEATURE (1)..(9): Peptide No. 99.0359
AVIFTPIYY

SEQ ID NO: 755 - protein, 9 aa, Plasmodium falciparum
  MISC_FEATURE (1)..(9): Peptide No. 99.0360
ALERLLSLK

SEQ ID NO: 756 - protein, 9 aa, Plasmodium falciparum
  MISC_FEATURE (1)..(9): Peptide No. 99.0361
SISGKYDIK

SEQ ID NO: 757 - protein, 9 aa, Plasmodium falciparum
  MISC_FEATURE (1)..(9): Peptide No. 99.0362
ILCIEGEQK

SEQ ID NO: 758 - protein, 9 aa, Plasmodium falciparum
  MISC_FEATURE (1)..(9): Peptide No. 99.0363
EQRLPLLPK

SEQ ID NO: 759 - protein, 8 aa, Plasmodium falciparum
  MISC_FEATURE (1)..(9): Peptide No. 99.0364
IFLRFIPD

SEQ ID NO: 760 - protein, 9 aa, Plasmodium falciparum
  MISC_FEATURE (1)..(9): Peptide No. 99.0365
IALLIIPPK

SEQ ID NO: 761 - protein, 9 aa, Plasmodium falciparum
  MISC_FEATURE (1)..(9): Peptide No. 99.0366
PVVCSMEYK

SEQ ID NO: 762 - protein, 9 aa, Plasmodium falciparum
  MISC_FEATURE (1)..(9): Peptide No. 99.0367
VVCSMEYKK

SEQ ID NO: 763 - protein, 9 aa, Plasmodium falciparum
  MISC_FEATURE (1)..(9): Peptide No. 99.0368
FSYDLRLNK

SEQ ID NO: 764 - protein, 9 aa, Plasmodium falciparum
  MISC_FEATURE (1)..(9): Peptide No. 99.0369
HLNIPIGFK

SEQ ID NO: 765 - protein, 10 aa, Plasmodium falciparum
  MISC_FEATURE (1)..(10): Peptide No. 99.0243
SSPLFNNFYK

SEQ ID NO: 766 - protein, 10 aa, Plasmodium falciparum
  MISC_FEATURE (1)..(10): Peptide No. 99.0244
FLYLLNKKNK

SEQ ID NO: 767 - protein, 10 aa, Plasmodium falciparum
  MISC_FEATURE (1)..(10): Peptide No. 99.0245
LQMMNVNLQK

SEQ ID NO: 768 - protein, 10 aa, Plasmodium falciparum
  MISC_FEATURE (1)..(10): Peptide No. 99.0246
LTNHLINTPK

SEQ ID NO: 769 - protein, 10 aa, Plasmodium falciparum
  MISC_FEATURE (1)..(10): Peptide No. 99.0247
IFISFYLINK

SEQ ID NO: 770 - protein, 10 aa, Plasmodium falciparum
  MISC_FEATURE (1)..(10): Peptide No. 99.0248
RLFEESLGIR

SEQ ID NO: 771 - protein, 9 aa, Plasmodium falciparum
  MISC_FEATURE (1)..(9): Peptide No. 99.0370
PLFNNFYKR

SEQ ID NO: 772 - protein, 9 aa, Plasmodium falciparum
  MISC_FEATURE (1)..(9): Peptide No. 99.0371
YQNFQNADK

SEQ ID NO: 773 - protein, 9 aa, Plasmdium falciparum
  MISC_FEATURE (1)..(9): Peptide No. 99.0372
QMMNVNLQK

SEQ ID NO: 774 - protein, 9 aa, Plasmodium falciparum
  MISC_FEATURE (1)..(9): Peptide No. 99.0373
AVSEIQNNK

SEQ ID NO: 775 - protein, 9 aa, Plasmodium falciparum
  MISC_FEATURE (1)..(9): Peptide No. 99.0374
GTMYILLKK

SEQ ID NO: 776 - protein, 9 aa, Plasmodium falciparum
  MISC_FEATURE (1)..(9): Peptide No. 99.0375
FISFYLINK

SEQ ID NO: 777 - protein, 9 aa, Plasmodium falciparum
  MISC_FEATURE (1)..(9): Peptide No. 99.0376
YLINKHWQR

SEQ ID NO: 778 - protein, 9 aa, Plasmodium falciparum
  MISC_FEATURE (1)..(9): Peptide No. 99.0377
ALKISQLQK

SEQ ID NO: 779 - protein, 9 aa, Plasmodium falciparum
  MISC_FEATURE (1)..(9): Peptide No. 99.0378
KINSNFLLK

SEQ ID NO: 780 - protein, 10 aa, Plasmodium falciparum
  MISC_FEATURE (1)..(10): Peptide No. 99.0249
QLKHFFNSNK

SEQ ID NO: 781 - protein, 10 aa, Plasmodium falciparum
  MISC_FEATURE (1)..(10): Peptide No. 99.0250
YVSMYIPFIK

SEQ ID NO: 782 - protein, 10 aa, Plasmodium falciparum
  MISC_FEATURE (1)..(10): Peptide No. 99.0251
VLFYIYNMYH

SEQ ID NO: 783 - protein, 10 aa, Plasmodium falciparum
  MISC_FEATURE (1)..(10): Peptide No. 99.0252
YTYIFFNYDK

SEQ ID NO: 784 - protein, 10 aa, Plasmodium falciparum
  MISC_FEATURE (1)..(10): Peptide No. 99.0253
SFFITYSYWK

SEQ ID NO: 785 - protein, 9 aa, Plasmodium falciparum
  MISC_FEATURE (1)..(9): Peptide No. 99.0379
STSNKHINR

SEQ ID NO: 786 - protein, 9 aa, Plasmodium falciparum
  MISC_FEATURE (1)..(9): Peptide No. 99.0380
SQCNDYYIK

SEQ ID NO: 787 - protein, 9 aa, Plasmodium falciparum
  MISC_FEATURE (1)..(9): Peptide No. 99.0381
SSIFYIKNK

SEQ ID NO: 788 - protein, 9 aa, Plasmodium falciparum
  MISC_FEATURE (1)..(9): Peptide No. 99.0382
LFFREKFLK

SEQ ID NO: 789 - protein, 9 aa, Plasmodium falciparum
  MISC_FEATURE (1)..(9): Peptide No. 99.0383
ILDNVSFLK

SEQ ID NO: 790 - protein, 10 aa, Plasmodium falciparum
  MISC_FEATURE (1)..(10): Peptide No. 99.0254
ILVLDIPGFK

SEQ ID NO: 791 - protein, 10 aa, Plasmodium falciparum
  MISC_FEATURE (1)..(10): Peptide No. 99.0255
ETYGDSLVLH

SEQ ID NO: 792 - protein, 10 aa, Plasmodium falciparum
  MISC_FEATURE (1)..(10)
  MISC_FEATURE (1)..(10): Peptide No. 99.0256
EVGYFKRIFK

SEQ ID NO: 793 - protein, 9 aa, Plasmodium falciparum
  MISC_FEATURE (1)..(9): Peptide No. 99.0384
LVLDIPGFK

SEQ ID NO: 794 - protein, 9 aa, Plasmodium falciparum
  MISC_FEATURE (1)..(9): Peptide No. 99.0385
GMLTVAGPR

SEQ ID NO: 795 - protein, 9 aa, Plasmodium falciparum
  MISC_FEATURE (1)..(9): Peptide No. 99.0386
SQTELFETY

SEQ ID NO: 796 - protein, 9 aa, Plasmodium falciparum
  MISC_FEATURE (1)..(9): Peptide No. 99.0387
GDSLVLHAK

SEQ ID NO: 797 - protein, 9 aa, Plasmodium falciparum
  MISC_FEATURE (1)..(9): Peptide No. 99.0388
SLVLHAKER

SEQ ID NO: 798 - protein, 9 aa, Plasmodium falciparum
  MISC_FEATURE (1)..(9): Peptide No. 99.0389
VGYFKRIFK

SEQ ID NO: 799 - protein, 9 aa, Plasmodium falciparum
  MISC_FEATURE (1)..(9): Peptide No. 99.0390
NIYIYIYIY

SEQ ID NO: 800 - protein, 9 aa, Plasmodium falciparum
  MISC_FEATURE (1)..(9): Peptide No. 99.0391
YIYIYIYIY

SEQ ID NO: 801 - protein, 10 aa, Plasmodium falciparum
  MISC_FEATURE (1)..(10): Peptide No. 99.0257
SSFNCDIANK

SEQ ID NO: 802 - protein, 10 aa, Plasmodium falciparum
  MISC_FEATURE (1)..(10): Peptide No. 99.0258
SMGVFCLKEK

SEQ ID NO: 803 - protein, 10 aa, Plasmodium falciparum
  MISC_FEATURE (1)..(10): Peptide No. 99.0259
HIVKNRIYNK

SEQ ID NO: 804 - protein, 10 aa, Plasmodium falciparum
  MISC_FEATURE (1)..(10): Peptide No. 99.0260
KLKLHKIIRK

SEQ ID NO: 805 - protein, 10 aa, Plasmodium falciparum
  MISC_FEATURE (1)..(10): Peptide No. 99.0261
FIFDIFKYAR

SEQ ID NO: 806 - protein, 10 aa, Plasmodium falciparum
  MISC_FEATURE (1)..(10): Peptide No. 99.0262
AQKALSNLHK

SEQ ID NO: 807 - protein, 10 aa, Plasmodium 808
  MISC_FEATURE (1)..(10): Peptide No. 99.0263
NLHKSWLQYK

SEQ ID NO: 808 - protein, 10 aa, Plasmodium falciparum
  MISC_FEATURE (1)..(10): Peptide No. 99.0264
YLPLFLMMEH

SEQ ID NO: 809 - protein, 9 aa, Plasmodium falciparum
  MISC_FEATURE (1)..(9): Peptide No. 99.0392
SFNCDIANK

SEQ ID NO: 810 - protein, 9 aa, Plasmodium falciparum
  MISC_FEATURE (1)..(9): Peptide No. 99.0393
KINKKYNKK

SEQ ID NO: 811 - protein, 9 aa, Plasmodium falciparum
  MISC_FEATURE (1)..(9): Peptide No. 99.0394
ILNNKELFK

SEQ ID NO: 812 - protein, 9 aa, Plasmodium falciparum
  MISC_FEATURE (1)..(9): Peptide No. 99.0395
IVKNRIYNK

SEQ ID NO: 813 - protein, 9 aa, Plasmodium falciparum
  MISC_FEATURE (1)..(9): Peptide No. 99.0396
LINSKVFCY

SEQ ID NO: 814 - protein, 9 aa, Plasmodium falciparum
  MISC_FEATURE (1)..(9): Peptide No. 99.0397
RQKEFYPIK

SEQ ID NO: 815 - protein, 10 aa, Plasmodium falciparum
  MISC_FEATURE (1)..(10): Peptide No. 99.0265
SFLVVLVFNK

SEQ ID NO: 816 - protein, 10 aa, Plasmodium falciparum
  MISC_FEATURE (1)..(10): Peptide No. 99.0266
STYMTPSAIK

SEQ ID NO: 817 - protein, 10 aa, Plasmodium falciparum
  MISC_FEATURE (1)..(10): Peptide No. 99.0267
KLYGEFTMNK

SEQ ID NO: 818 - protein, 10 aa, Plasmodium falciparum
  MISC_FEATURE (1)..(10): Peptide No. 99.0268
GVYYIFVYLR

SEQ ID NO: 819 - protein, 9 aa, Plasmodium falciparum
  MISC_FEATURE (1)..(9): Peptide No. 99.0398
SQYSNYFDY

SEQ ID NO: 820 - protein, 9 aa, Plasmodium falciparum
  MISC_FEATURE (1)..(9): Peptide No. 99.0399
LFITYFQQK

SEQ ID NO: 821 - protein, 9 aa, Plasmodium falciparum
  MISC_FEATURE (1)..(9): Peptide No. 99.0400
ATSWDEYPK

SEQ ID NO: 822 - protein, 9 aa, Plasmodium falciparum
  MISC_FEATURE (1)..(9): Peptide No. 99.0401
ASFAAHENK

SEQ ID NO: 823 - protein, 9 aa, Plasmodium falciparum
  MISC_FEATURE (1)..(9): Peptide No. 99.0402
MLKADYFIR

SEQ ID NO: 824 - protein, 9 aa, Plasmodium falciparum
  MISC_FEATURE (1)..(9): Peptide No. 99.0403
VLNPVTIPK

SEQ ID NO: 825 - protein, 10 aa, Plasmodium falciparum
  MISC_FEATURE (1)..(10): Peptide No. 99.0269
VSYIFFMSFK

SEQ ID NO: 826 - protein, 10 aa, Plasmodium falciparum
  MISC_FEATURE (1)..(10): Peptide No. 99.0269
VSYIFFMSFK

SEQ ID NO: 827 - protein, 9 aa, Plasmodium falciparum
  MISC_FEATURE (1)..(9): Peptide No. 99.0404
STFFFFLSR

SEQ ID NO: 828 - protein, 9 aa, Plasmodium falciparum
  MISC_FEATURE (1)..(9): Peptide No. 99.0405
LLLTFGVYY

SEQ ID NO: 829 - protein, 9 aa, Plasmodium falciparum
  MISC_FEATURE (1)..(9): Peptide No. 99.0406
KFLFRYKQK

SEQ ID NO: 830 - protein, 9 aa, Plasmodium falciparum
  MISC_FEATURE (1)..(9): Peptide No. 99.0407
KVFIKGKGK

SEQ ID NO: 831 - protein, 9 aa, Plasmodium falciparum
  MISC_FEATURE (1)..(9): Peptide No. 99.0408
ITYIWIILK

SEQ ID NO: 832 - protein, 9 aa, Plasmodium falciparum
  MISC_FEATURE (1)..(9): Peptide No. 99.0409
KFFFFVFFY

SEQ ID NO: 833 - protein, 9 aa, Plasmodium falciparum
  MISC_FEATURE (1)..(9): Peptide No. 99.0410
KLLQKLISK

SEQ ID NO: 834 - protein, 9 aa, Plasmodium falciparum
  MISC_FEATURE (1)..(9): Peptide No. 99.0411
ILNILKLAK

SEQ ID NO: 835 - protein, 9 aa, Plasmodium falciparum
  MISC_FEATURE (1)..(9): Peptide No. 99.0412
SQNNFSKIK

SEQ ID NO: 836 - protein, 9 aa, Plasmodium falciparum
  MISC_FEATURE (1)..(9): Peptide No. 99.0413
SSLNIYNTK

SEQ ID NO: 837 - protein, 9 aa, Plasmodium falciparum
  MISC_FEATURE (1)..(9): Peptide No. 99.0414
KLFNYKFFK

SEQ ID NO: 838 - protein, 9 aa, Plasmodium falciparum
  MISC_FEATURE (1)..(9): Peptide No. 99.0415
LTFLSNIRK

SEQ ID NO: 839 - protein, 9 aa, Plasmodium falciparum
  MISC_FEATURE (1)..(9): Peptide No. 99.0416
KFFYIFHYK

SEQ ID NO: 840 - protein, 9 aa, Plasmodium falciparum
  MISC_FEATURE (1)..(9): Peptide No. 99.0417
VTCSYFIIR

SEQ ID NO: 841 - protein, 9 aa, Plasmodium falciparum
  MISC_FEATURE (1)..(9): Peptide No. 99.0418
LTCAFKIYK

SEQ ID NO: 842 - protein, 9 aa, Plasmodium falciparum
  MISC_FEATURE (1)..(9): Peptide No. 99.0419
ILFILFFIK

SEQ ID NO: 843 - protein, 9 aa, Plasmodium falciparum
  MISC_FEATURE (1)..(9): Peptide No. 99.0420
NLYFFIHNR

SEQ ID NO: 844 - protein, 9 aa, Plasmodium falciparum
  MISC_FEATURE (1)..(9): Peptide No. 99.0421
IFLHYYFKK

SEQ ID NO: 845 - protein, 10 aa, Plasmodium falciparum
  MISC_FEATURE (1)..(10): Peptide No. 99.0271
QVFFLQEMER

SEQ ID NO: 846 - protein, 9 aa, Plasmodium falciparum
  MISC_FEATURE (1)..(9): Peptide No. 99.0422
SFYKFEVEK

SEQ ID NO: 847 - protein, 9 aa, Plasmodium falciparum
  MISC_FEATURE (1)..(9): Peptide No. 99.0423
KTFREHFLK

SEQ ID NO: 848 - protein, 9 aa, Plasmodium falciparum
  MISC_FEATURE (1)..(9): Peptide No. 99.0424
VSNSSQLFK

SEQ ID NO: 849 - protein, 9 aa, Plasmodium falciparum
  MISC_FEATURE (1)..(9): Peptide No. 99.0425
SLLNDVFPK

SEQ ID NO: 850 - protein, 9 aa, Plasmodium falciparum
  MISC_FEATURE (1)..(9): Peptide No. 99.0426
KLFIFYLDK

SEQ ID NO: 851 - protein, 9 aa, Plasmodium falciparum
  MISC_FEATURE (1)..(9): Peptide No. 99.0427
LLNSQIIQY

SEQ ID NO: 852 - protein, 9 aa, Plasmodium falciparum
  MISC_FEATURE (1)..(9): Peptide No. 99.0428
FQGFYFLDK

SEQ ID NO: 853 - protein, 9 aa, Plasmodium falciparum
  MISC_FEATURE (1)..(9): Peptide No. 99.0429
NTFSFSWMK

SEQ ID NO: 854 - protein, 9 aa, Plasmodium falciparum
  MISC_FEATURE (1)..(9): Peptide No. 99.0430
MFYNCPVYK

SEQ ID NO: 855 - protein, 10 aa, Plasmodium falciparum
  MISC_FEATURE (1)..(10): Peptide No. 99.0272
NLLRHAIFYK

SEQ ID NO: 856 - protein, 10 aa, Plasmodium falciparum
  MISC_FEATURE (1)..(10): Peptide No. 99.0273
SSYGYNIYFK

SEQ ID NO: 857 - protein, 10 aa, Plasmodium falciparum
  MISC_FEATURE (1)..(10): Peptide No. 99.0274
RTYVNEYFLR

SEQ ID NO: 858 - protein, 10 aa, Plasmodium falciparum
  MISC_FEATURE (1)..(9): Peptide No. 99.0431
RTYVNEYFLR

SEQ ID NO: 859 - protein, 9 aa, Plasmodium falciparum
  MISC_FEATURE (1)..(9): Peptide No. 99.0432
CQNSLNYSK

SEQ ID NO: 860 - protein, 9 aa, Plasmodium falciparum
  MISC_FEATURE (1)..(9): Peptide No. 99.0433
IVNNTELNK

SEQ ID NO: 861 - protein, 9 aa, Plasmodium falciparum
  MISC_FEATURE (1)..(9): Peptide No. 99.0434
TLFSQNLFY

SEQ ID NO: 862 - protein, 9 aa, Plasmodium falciparum
  MISC_FEATURE (1)..(9): Peptide No. 99.0435
TFYESVFTR

SEQ ID NO: 863 - protein, 9 aa, Plasmodium falciparum
  MISC_FEATURE (1)..(9): Peptide No. 99.0436
YFFEEFFNK

SEQ ID NO: 864 - protein, 9 aa, Plasmodium falciparum
  MISC_FEATURE (1)..(9): Peptide No. 99.0437
TTQSNNIYK

SEQ ID NO: 865 - protein, 10 aa, Plasmodium falciparum
  MISC_FEATURE (1)..(10): Peptide No. 99.0275
SLFYFTSNGK

SEQ ID NO: 866 - protein, 9 aa, Plasmodium falciparum
  MISC_FEATURE (1)..(9): Ppetide No. 99.0438
KLNYDNFEK

SEQ ID NO: 867 - protein, 9 aa, Plasmodium falciparum
  MISC_FEATURE (1)..(9): Peptide No. 99.0439
ILCDDGIYR

SEQ ID NO: 868 - protein, 9 aa, Plasmodium falciparum
  MISC_FEATURE (1)..(9): Peptide No. 99.0440
KVADVFLQH

SEQ ID NO: 869 - protein, 9 aa, Plasmodium falciparum
  MISC_FEATURE (1)..(9): Peptide No. 99.0441
STSFLFLRK

SEQ ID NO: 870 - protein, 9 aa, Plasmodium falciparum
  MISC_FEATURE (1)..(9): Peptide No. 99.0442
SFLFLRKQK

SEQ ID NO: 871 - protein, 9 aa, Plasmodium falciparum
  MISC_FEATURE (1)..(9): Peptide No. 99.0443
SFFSSCENK

SEQ ID NO: 872 - protein, 9 aa, Plasmodium falciparum
  MISC_FEATURE (1)..(9): Peptide No. 99.0444
AQSSYIYNK

SEQ ID NO: 873 - protein, 9 aa, Plasmodium falciparum
  MISC_FEATURE (1)..(9): Peptide No. 99.0445
MSAKYLYHK

SEQ ID NO: 874 - protein, 9 aa, Plasmodium falciparum
  MISC_FEATURE (1)..(9): Peptide No. 99.0446
TTLFSHFNK

SEQ ID NO: 875 - protein, 9 aa, Plasmodium falciparum
  MISC_FEATURE (1)..(9): Peptide No. 99.0447
SVYYNTMLR

SEQ ID NO: 876 - protein, 10 aa, Plasmodium falciparum
  MISC_FEATURE (1)..(10): Peptide No. 99.0276
VVNFLFELYK

SEQ ID NO: 877 - protein, 10 aa, Plasmodium falciparum
  MISC_FEATURE (1)..(10): Peptide No. 99.0277
TFFLWDRYKK

SEQ ID NO: 878 - protein, 9 aa, Plasmodium falciparum
  MISC_FEATURE (1)..(9): Peptide No. 99.0448
SVGACAPYR

SEQ ID NO: 879 - protein, 9 aa, Plasmodium falciparum
  MISC_FEATURE (1)..(9): Peptide No. 99.0449
KQLEDNLRK

SEQ ID NO: 880 - protein, 9 aa, Plasmodium falciparum
  MISC_FEATURE (1)..(9): Peptide No. 99.0450
KVASNMHHK

SEQ ID NO: 881 - protein, 9 aa, Plasmodium falciparum
  MISC_FEATURE (1)..(9): Peptide No. 99.0451
ASNMHHKKK

SEQ ID NO: 882 - protein, 9 aa, Plasmodium falciparum
  MISC_FEATURE (1)..(9): Peptide No. 99.0452
AGFISNTYK

SEQ ID NO: 883 - protein, 9 aa, Plasmodium falciparum
  MISC_FEATURE (1)..(9): Peptide 99.0453
ILAFKEIYK

SEQ ID NO: 884 - protein, 9 aa, Plasmodium falciparum
  MISC_FEATURE (1)..(9): Peptide No. 99.0454
ALFKRWLEY

SEQ ID NO: 885 - protein, 9 aa, Plasmodium falciparum
  MISC_FEATURE (1)..(9): Peptide No. 99.0455
AFTYFYLKK

SEQ ID NO: 886 - protein, 10 aa, Plasmodium falciparum
  MISC_FEATURE (1)..(10): Peptide No. 99.0278
FFFSNVNNNK

SEQ ID NO: 887 - protein, 10 aa, Plasmodium falciparum
  MISC_FEATURE (1)..(10): Peptide No. 99.0279
SQGKKNTYLK

SEQ ID NO: 888 - protein, 10 aa, Plasmodium falciparum
  MISC_FEATURE (1)..(10): Peptide No. 99.0280
VFNNSIILEK

SEQ ID NO: 889 - protein, 10 aa, Plasmodium falciparum
  MISC_FEATURE (1)..(10): Peptide No. 99.0281
SVSEGYTSTY

SEQ ID NO: 890 - protein, 9 aa, Plasmodium falciparum
  MISC_FEATURE (1)..(9): Peptide No. 99.0456
TSICKYWIK

SEQ ID NO: 891 - protein, 9 aa, Plasmodium falciparum
  MISC_FEATURE (1)..(9): Peptide No. 99.0457
TTICKHWKK

SEQ ID NO: 892 - protein, 9 aa, Plasmodium falciparum
  MISC_FEATURE (1)..(9): Peptide No. 99.0458
KVTNVHIYK

SEQ ID NO: 893 - protein, 9 aa, Plasmodium falciparum
  MISC_FEATURE (1)..(9): Peptide No. 99.0459
ITNMNNINR

SEQ ID NO: 894 - protein, 9 aa, Plasmodium falciparum
  MISC_FEATURE (1)..(9): Peptide No. 99.0460
MLNIYKINK

SEQ ID NO: 895 - protein, 9 aa, Plasmodium falciparum
  MISC_FEATURE (1)..(9): Peptide No. 99.0461
IINSYIDYK

SEQ ID NO: 896 - protein, 9 aa, Plasmodium falciparum
  MISC_FEATURE (1)..(9): Peptide No. 99.0462
NLYTYVVNK

SEQ ID NO: 897 - protein, 9 aa, Plasmodium falciparum
  MISC_FEATURE (1)..(9): Peptide No. 99.0463
KMIYSIFIK

SEQ ID NO: 898 - protein, 10 aa, Plasmodium falciparum
  MISC_FEATURE (1)..(10): Peptide No. 99.0282
ISMDKSLFFK

SEQ ID NO: 899 - protein, 10 aa, Plasmodium falciparum
  MISC_FEATURE (1)..(10): Peptide No. 99.0283
TVFLDYVKGK

SEQ ID NO: 900 - protein, 10 aa, Plasmodium falciparum
  MISC_FEATURE (1)..(10): Peptide No. 99.0284
DVYKETNMNR

SEQ ID NO: 901 - protein, 10 aa, Plasmodium falciparum
  MISC_FEATURE (1)..(10): Peptide No. 99.0285
KLKKSTICNK

SEQ ID NO: 902 - protein, 9 aa, Plasmodium falciparum
  MISC_FEATURE (1)..(9): Peptide No. 99.0464
SMDKSLFFK

SEQ ID NO: 903 - protein, 9 aa, Plasmodium falciparum
  MISC_FEATURE (1)..(9): Peptide No. 99.0465
KSLFFKSLK

SEQ ID NO: 904 - protein, 9 aa, Plasmodium falciparum
  MISC_FEATURE (1)..(9): Peptide No. 99.0466
VFLDYVKGK

SEQ ID NO: 905 - protein, 9 aa, Plasmodium falciparum
  MISC_FEATURE (1)..(9): Peptide No. 99.0467
KVKRFRVFK

SEQ ID NO: 906 - protein, 9 aa, Plasmodium falciparum
  MISC_FEATURE (1)..(9): Peptide No. 99.0468
SFFIDEVKK

SEQ ID NO: 907 - protein, 9 aa, Plasmodium falciparum
  MISC_FEATURE (1)..(9): Peptide No. 99.0469
KIYENKLKK

SEQ ID NO: 908 - protein, 10 aa, Plasmodium falciparum
  MISC_FEATURE (1)..(10): Peptide No. 99.0286
ALTYMYCVYY

SEQ ID NO: 909 - protein, 10 aa, Plasmodium falciparum
  MISC_FEATURE (1)..(10): Peptide No. 99.0287
SQISIFCNLR

SEQ ID NO: 910 - protein, 10 aa, Plasmodium falciparum
  MISC_FEATURE (1)..(10): Peptide No. 99.0288
QISIFCNLRR

SEQ ID NO: 911 - protein, 10 aa, Plasmodium falciparum
  MISC_FEATURE (1)..(10): Peptide No. 99.0289
VCNNETYYNK

SEQ ID NO: 912 - protein, 10 aa, Plasmodium falciparum
  MISC_FEATURE (1)..(10): Peptide No. 99.0290
KAHEENDKVK

SEQ ID NO: 913 - protein, 9 aa, Plasmodium falciparum
  MISC_FEATURE (1)..(9): Peptide No. 99.0470
ALTYMYCVY

SEQ ID NO: 914 - protein, 9 aa, Plasmodium falciparum
  MISC_FEATURE (1)..(9): Peptide No. 99.0471
QISIFCNLR

SEQ ID NO: 915 - protein, 9 aa, Plasmodium falciparum
  MISC_FEATURE (1)..(9): Peptide No. 99.0472
ISIFCNLRR

SEQ ID NO: 916 - protein, 9 aa, Plasmodium falciparum
  MISC_FEATURE (1)..(9): Peptide No. 99.0473
NVCNNETYY

SEQ ID NO: 917 - protein, 10 aa, Plasmodium falciparum
  MISC_FEATURE (1)..(10): Peptide No. 99.0291
LVEFIFLLLK

SEQ ID NO: 918 - protein, 10 aa, Plasmodium falciparum
  MISC_FEATURE (1)..(10): Peptide No. 99.0292
SVFYNKEIIK

SEQ ID NO: 919 - protein, 10 aa, Plasmodium falciparum
  MISC_FEATURE (1)..(10): Peptide No. 99.0293
SLKDFDMLLY

SEQ ID NO: 920 - protein, 9 aa, Plasmodium falciparum
  MISC_FEATURE (1)..(9): Peptide No. 99.0474
NVNDRFVEK

SEQ ID NO: 921 - protein, 9 aa, Plasmodium falciparum
  MISC_FEATURE (1)..(9): Peptide No. 99.0475
TLSNSLPQK

SEQ ID NO: 922 - protein, 9 aa, Plasmodium falciparum
  MISC_FEATURE (1)..(9): Peptide No. 99.0476
YQINNFIHK

SEQ ID NO: 923 - protein, 9 aa, Plasmodium falciparum
  MISC_FEATURE (1)..(9): Peptide No. 99.0477
NLTINNFQK

SEQ ID NO: 924 - protein, 9 aa, Plasmodium falciparum
  MISC_FEATURE (1)..(9): Peptide No. 99.0478
KFNRDMLQK

SEQ ID NO: 925 - protein, 9 aa, Plasmodium falciparum
  MISC_FEATURE (1)..(9): Peptide No. 99.0479
NQSDFLLLK

SEQ ID NO: 926 - protein, 9 aa, Plasmodium falciparum
  MISC_FEATURE (1)..(9): Peptide No. 99.0480
SFHHFNIDK

SEQ ID NO: 927 - protein, 9 aa, Plasmodium falciparum
  MISC_FEATURE (1)..(9): Peptide No. 99.0481
KSKELLLQK

SEQ ID NO: 928 - protein, 15 aa, Plasmodium falciparum
  MISC_FEATURE (1)..(15): Peptide No. 100.0001
LSHFKKNFILQNNEE

SEQ ID NO: 929 - protein, 15 aa, Plasmodium falciparum
  MISC_FEATURE (1)..(15): Peptide No. 100.0002
TTFLSALKLLKIAQY

SEQ ID NO: 930 - protein, 15 aa, Plasmodium falciparum
  MISC_FEATURE (1)..(15): Peptide No. 100.0003
NNKLSKNLSQLVHFY

SEQ ID NO: 931 - protein, 15 aa, Plasmodium falciparum
  MISC_FEATURE (1)..(15): Peptide No. 100.0004
KIYMFGGFSKGVRNN

SEQ ID NO: 932 - protein, 15 aa, Plasmodium falciparum
  MISC_FEATURE (1)..(15): Peptide No. 100.0005
DDMIGMPNLSSTVVC

SEQ ID NO: 933 - protein, 15 aa, Plasmodium falciparum
  MISC_FEATURE (1)..(15): Peptide No. 100.0006
TFTFQNMYVRSKVVS

SEQ ID NO: 934 - protein, 15 aa, Plasmodium falciparum
  MISC_FEATURE (1)..(15): Peptide No. 100.0007
KYEIIGNILIFHYKY

SEQ ID NO: 935 - protein, 15 aa, Plasmodium falciparum
  MISC_FEATURE (1)..(15): Peptide No. 100.0008
KERMKNMYIVSNNDD

SEQ ID NO: 936 - protein, 15 aa, Plasmodium falciparum
  MISC_FEATURE (1)..(15): Peptide No. 100.0009
GVGYFTLPLLKCIEA

SEQ ID NO: 937 - protein, 15 aa, Plasmodium falciparum
  MISC_FEATURE (1)..(15): Peptide No. 100.0010
HRIILGLLPHSQPAW

SEQ ID NO: 938 - protein, 15 aa, Plasmodium falciparum
  MISC_FEATURE (1)..(15): Peptide No. 100.0011
HFFLFLLYILFLVKM

SEQ ID NO: 939 - protein, 15 aa, Plasmodium falciparum
  MISC_FEATURE (1)..(15): Peptide No. 100.0012
LFLLYILFLVKMNAL

SEQ ID NO: 940 - protein, 15 aa, Plasmodium falciparum
  MISC_FEATURE (1)..(15): Peptide No. 100.0013
ILFLVKMNALRRLPV

SEQ ID NO: 941 - protein, 15 aa, Plasmodium falciparum
  MISC_FEATURE (1)..(15): Peptide No. 100.0014
MNALRRLPVICSFLV

SEQ ID NO: 942 - protein, 15 aa, Plasmodium falciparum
  MISC_FEATURE (1)..(15): Peptide No. 100.0015
SAFLESQSMNKIGDD

SEQ ID NO: 943 - protein, 15 aa, Plasmodium falciparum
  MISC_FEATURE (1)..(15): Peptide No. 100.0016
LKELIKVGLPSFENL

SEQ ID NO: 944 - protein, 15 aa, Plasmodium falciparum
  MISC_FEATURE (1)..(15): Peptide No. 100.0017
FENLVAENVKPPKVD

SEQ ID NO: 945 - protein, 15 aa, Plasmodium falciparum
  MISC_FEATURE (1)..(15): Peptide No. 100.0018
AENVKPPKVDPATYG

SEQ ID NO: 946 - protein, 15 aa, Plasmodium falciparum
  MISC_FEATURE (1)..(15): Peptide No. 100.0019
PATYGIIVPVLTSLF

SEQ ID NO: 947 - protein, 15 aa, Plasmodium falciparum
  MISC_FEATURE (1)..(15): Peptide No. 100.0020
YGIIVPVLTSLFNKV

SEQ ID NO: 948 - protein, 15 aa, Plasmodium falciparum
  MISC_FEATURE (1)..(15): Peptide No. 100.0021
SVDLQIKISMKVLNS

SEQ ID NO: 949 - protein, 15 aa, Plasmodium falciparum
  MISC_FEATURE (1)..(15): Peptide No. 100.0022
KISMKVLNSMFHIIM

SEQ ID NO: 950 - protein, 15 aa, Plasmodium falciparum
  MISC_FEATURE (1)..(15): Peptide No. 100.0023
KDVVQIQTVLLSLGF

SEQ ID NO: 951 - protein, 15 aa, Plasmodium falciparum
  MISC_FEATURE (1)..(15): Peptide No. 100.0024
SQIIIILPSILENIL

SEQ ID NO: 952 - protein, 15 aa, Plasmodium falciparum
  MISC_FEATURE (1)..(15): Peptide No. 100.0025
MHSVKEMIVYLIQNN

SEQ ID NO: 953 - protein, 15 aa, Plasmodium falciparum
  MISC_FEATURE (1)..(15): Peptide No. 100.0026
TINLINELMKRQHDK

SEQ ID NO: 954 - protein, 15 aa, Plasmodium falciparum
  MISC_FEATURE (1)..(15): Peptide No. 100.0027
REMLLKMKSMSRNQR

SEQ ID NO: 955 - protein, 15 aa, Plasmodium falciparum
  MISC_FEATURE (1)..(15): Peptide No. 100.0028
RSIIFAGHTIELNSL

SEQ ID NO: 956 - protein, 15 aa, Plasmodium falciparum
  MISC_FEATURE (1)..(15): Peptide No. 100.0029
NSLMFKQTSGRAGRR

SEQ ID NO: 957 - protein, 15 aa, Plasmodium falciparum
  MISC_FEATURE (1)..(15): Peptide No. 100.0030
NLIITYLLIKKVLHN

SEQ ID NO: 958 - protein, 15 aa, Plasmodium falciparum
  MISC_FEATURE (1)..(15): Peptide No. 100.0031
MRKLAILSVSSFLFV

SEQ ID NO: 959 - protein, 15 aa, Plasmodium falciparum
  MISC_FEATURE (1)..(15): Peptide No. 100.0032
ELNYDNAGTNLYNEL

SEQ ID NO: 960 - protein, 15 aa, Plasmodium falciparum
  MISC_FEATURE (1)..(15): Peptide No. 100.0033
QVRIKPGSANKPKDE

SEQ ID NO: 961 - protein, 15 aa, Plasmodium falciparum
  MISC_FEATURE (1)..(15): Peptide No. 100.0034
LLKIWKNYMKIMNHL

SEQ ID NO: 962 - protein, 15 aa, Plasmodium falicparum
  MISC_FEATURE (1)..(15): Peptide No. 100.0035
MTLYQIQVMKRNQKQ

SEQ ID NO: 963 - protein, 15 aa, Plasmodium falciparum
  MISC_FEATURE (1)..(15): Peptide No. 100.0036
QKQVQMMIMIKFMGV

SEQ ID NO: 964 - protein, 15 aa, Plasmodium falicparum
  MISC_FEATURE (1)..(15): Peptide No. 100.0037
MIMIKFMGVIYIMII

SEQ ID NO: 965 - protein, 15 aa, Plasmodium falciparum
  MISC_FEATURE (1)..(15): Peptide No. 100.0038
GVIYIMIISKKMMRK

SEQ ID NO: 966 - protein, 15 aa, Plasmodium falciparum
  MISC_FEATURE (1)..(15): Peptide No. 100.0039
LYYLFNQHIKKELYH

SEQ ID NO: 967 - protein, 15 aa, Plasmodium falciparum
  MISC_FEATURE (1)..(15): Peptide No. 100.0040
HFNMLKNKMQSSFFM

SEQ ID NO: 968 - protein, 15 aa, Plasmodium falciparum
  MISC_FEATURE (1)..(15): Peptide No. 100.0041
XDIYQKLYIKQEEQK

SEQ ID NO: 969 - protein, 15 aa, Plasmodium falciparum
  MISC_FEATURE (1)..(15): Peptide No. 100.0042
QKKYIYNLIMNTQNK

SEQ ID NO: 970 - protein, 15 aa, Plasmodium falciparum
  MISC_FEATURE (1)..(15): Peptide No. 100.0043
YEALIKLLPFSKRIR

SEQ ID NO: 971 - protein, 15 aa, Plasmodium falciparum
  MISC_FEATURE (1)..(15): Peptide No. 100.0044
NIHFAVLFLTLTVYP

SEQ ID NO: 972 - protein, 15 aa, Plasmodium falciparum
  MISC_FEATURE (1)..(15): Peptide No. 100.0045
AVLFLTLTVYPINNF

SEQ ID NO: 973 - protein, 15 aa, Plasmodium falciparum
  MISC_FEATURE (1)..(15): Peptide No. 100.0046
KLLYKMNYLKQDINN

SEQ ID NO: 974 - protein, 15 aa, Plasmodium falciparum
  MISC_FEATURE (1)..(15): Peptide No. 100.0047
KKEFKNSLILLNLYN

SEQ ID NO: 975 - protein, 15 aa, Plasmodium falciparum
  MISC_FEATURE (1)..(15): Peptide No. 100.0048
YLSFKILNTLLYNHI

SEQ ID NO: 976 - protein, 15 aa, Plasmodium falciparum
  MISC_FEATURE (1)..(15): Peptide No. 100.0049
IYILINHVIIPSLFY

SEQ ID NO: 977 - protein, 15 aa, Plasmodium falciparum
  MISC_FEATURE (1)..(15): Peptide No. 100.0050
IPSLFYLYMNFLKFI

SEQ ID NO: 978 - protein, 15 aa, Plasmodium falciparum
  MISC_FEATURE (1)..(15): Peptide No. 100.0051
KYLIILLYIFKLIEY

SEQ ID NO: 979 - protein, 15 aa, Plasmodium falciparum
  MISC_FEATURE (1)..(15): Peptide No. 100.0052
FIFMQNNQTKLAEMK

SEQ ID NO: 980 - protein, 15 aa, Plasmodium falciparum
  MISC_FEATURE (1)..(15): Peptide No. 100.0053
LFIYIWLHLIIIFIF

SEQ ID NO: 981 - protein, 15 aa, Plasmodium falciparum
  MISC_FEATURE (1)..(15): Peptide No. 100.0054
ILLIRPMLVKLRPKL

SEQ ID NO: 982 - protein, 15 aa, Plasmodium falciparum
  MISC_FEATURE (1)..(15): Peptide No. 100.0055
RPMLVKLRPKLVKLR

SEQ ID NO: 983 - protein, 15 aa, Plasmodium falciparum
  MISC_FEATURE (1)..(15): Peptide No. 100.0056
RPKLVKLRPMLVKLG

SEQ ID NO: 984 - protein, 15 aa, Plasmodium falciparum
  MISC_FEATURE (1)..(15): Peptide No. 100.0057
RPMLVKLGPILVKLR

SEQ ID NO: 985 - protein, 15 aa, Plasmodium falciparum
  MISC_FEATURE (1)..(15): Peptide No. 100.0058
GPILVKLRPMLVKLR

SEQ ID NO: 986 - protein, 15 aa, Plasmodium falciparum
  MISC_FEATURE (1)..(15): Peptide No. 100.0059
RPMLVKLRPMLAKLR

SEQ ID NO: 987 - protein, 15 aa, Plasmodium falciparum
  MISC_FEATURE (1)..(15): Peptide No. 100.0060
RPMLAKLRPMLAKLR

SEQ ID NO: 988 - protein, 15 aa, Plasmodium falciparum
  MISC_FEATURE (1)..(15): Peptide No. 100.0061
RPMLAKLRPKLVKLR

SEQ ID NO: 989 - protein, 15 aa, Plasmodium falciparum
  MISC_FEATURE (1)..(15): Peptide No. 100.0062
RPKLVKLRPKLVKLR

SEQ ID NO: 990 - protein, 15 aa, Plasmodium falciparum
  MISC_FEATURE (1)..(15): Peptide No. 100.0063
RPKLVKLRPISVNAK

SEQ ID NO: 991 - protein, 15 aa, Plasmodium falciparum
  MISC_FEATURE (1)..(15): Peptide No. 100.0064
ILEMKPNILLSRFIF

SEQ ID NO: 992 - protein, 15 aa, Plasmodium falciparum
  MISC_FEATURE (1)..(15): Peptide No. 100.0065
NISINNAFSLPVNIY

SEQ ID NO: 993 - protein, 15 aa, Plasmodium falciparum
  MISC_FEATURE (1)..(15): Peptide No. 100.0066
YFNIIQQKIQSNFLL

SEQ ID NO: 994 - protein, 15 aa, Plasmodium falciparum
  MISC_FEATURE (1)..(15): Peptide No. 100.0067
ISTFIKNNINHQENN

SEQ ID NO: 995 - protein, 15 aa, Plasmodium falciparum
  MISC_FEATURE (1)..(15): Peptide No. 100.0068
LKNMDGNILIKDFIQ

SEQ ID NO: 996 - protein, 15 aa, Plasmodium falciparum
  MISC_FEATURE (1)..(15): Peptide No. 100.0069
IEFYNINMAKKVMNN

SEQ ID NO: 997 - protein, 15 aa, Plasmodium falciparum
  MISC_FEATURE (1)..(15): Peptide No. 100.0070
NINMAKKVMNNMEKN

SEQ ID NO: 998 - protein, 15 aa, Plasmodium falciparum
  MISC_FEATURE (1)..(15): Peptide No. 100.0071
FVNYFEAVVHMNIHC

SEQ ID NO: 999 - protein, 15 aa, Plasmodium falciparum
  MISC_FEATURE (1)..(15): Peptide No. 100.0072
NNNIINGHMLEQKLS

SEQ ID NO: 1000 - protein, 15 aa, Plasmodium falciparum
  MISC_FEATURE (1)..(15): Peptide No. 100.0073
NNDMKKGYTNVSNNS

SEQ ID NO: 1001 - protein, 15 aa, Plasmodium falciparum
  MISC_FEATURE (1)..(15): Peptide No. 100.0074
NNEFFGYPLQFVCET

SEQ ID NO: 1002 - protein, 15 aa, Plasmodium falciparum
  MISC_FEATURE (1)..(15): Peptide No. 100.0075
FFIIKNVGVHKITYY

SEQ ID NO: 1003 - protein, 15 aa, Plasmodium falciparum
  MISC_FEATURE (1)..(15): Peptide No. 100.0076
KIEYISMLSPTINEI

SEQ ID NO: 1004 - protein, 15 aa, Plasmodium falciparum
  MISC_FEATURE (1)..(15): Peptide No. 100.0077
INEIKTLNTILTIPL

SEQ ID NO: 1005 - protein, 15 aa, Plasmodium falciparum
  MISC_FEATURE (1)..(15): Peptide No. 100.0078
LNTILTIPLIKMNEY

SEQ ID NO: 1006 - protein, 15 aa, Plasmodium falciparum
  MISC_FEATURE (1)..(15): Peptide No. 100.0079
HKLFINKLMTSNIRK

SEQ ID NO: 1007 - protein, 15 aa, Plasmodium falciparum
  MISC_FEATURE (1)..(15): Peptide No. 100.0080
QNRFRNQLLYLTKIA

SEQ ID NO: 1008 - protein, 15 aa, Plasmodium falciparum
  MISC_FEATURE (1)..(15): Peptide No. 100.0081
IKKIKTPLILPIDPN

SEQ ID NO: 1009 - protein, 15 aa, Plasmodium falciparum
  MISC_FEATURE (1)..(15): Peptide No. 100.0082
QDHLVIQIIYVMDNI

SEQ ID NO: 1010 - protein, 15 aa, Plasmodium falciparum
  MISC_FEATURE (1)..(15): Peptide No. 100.083
IEAMGGAHSIGYEQF

SEQ ID NO: 1011 - protein, 15 aa, Plasmodium falciparum
  MISC_FEATURE (1)..(15): Peptide No. 100.0084
FDDFKINYSYKTKNH

SEQ ID NO: 1012 - protein, 15 aa, Plasmodium falciparum
  MISC_FEATURE (1)..(15): Peptide No. 100.0085
ITDLNNMNVNQSNMK

SEQ ID NO: 1013 - protein, 15 aa, Plasmodium falciparum
  MISC_FEATURE (1)..(15): Peptide No. 100.0086
TNNFNNNVMMLMNTS

SEQ ID NO: 1014 - protein, 15 aa, Plasmodium falciparum
  MISC_FEATURE (1)..(15): Peptide No. 100.0087
EQNVAQNVAQNVAQN

SEQ ID NO: 1015 - protein, 15 aa, Plasmodium falciparum
  MISC_FEATURE (1)..(15): Peptide No. 100.0088
AQNVAQNVAQNVEQN

SEQ ID NO: 1016 - protein, 15 aa, Plasmodium falciparum
  MISC_FEATURE (1)..(15): Peptide No. 100.0089
SNKFMTPTTLKEKYQ

SEQ ID NO: 1017 - protein, 15 aa, Plasmodium falciparum
  MISC_FEATURE (1)..(15): Peptide No. 100.0090
NIHMINDVATKLNQH

SEQ ID NO: 1018 - protein, 15 aa, Plasmodium falciparum
  MISC_FEATURE (1)..(15): Peptide No. 100.0091
HIHMMNQQIQKETNT

SEQ ID NO: 1019 - protein, 15 aa, Plasmodium falciparum
  MISC_FEATURE (1)..(15): Peptide No. 100.0092
NNVFQQPLSYSNGSE

SEQ ID NO: 1020 - protein, 15 aa, Plasmodium falciparum
  MISC_FEATURE (1)..(15): Peptide No. 100.0093
NNTINMNGMNKTESI

SEQ ID NO: 1021 - protein, 15 aa, Plasmodium falciparum
  MISC_FEATURE (1)..(15): Peptide No. 100.0094
LNILILIDAASVAFL

SEQ ID NO: 1022 - protein, 15 aa, Plasmodium falciparum
  MISC_FEATURE (1)..(15): Peptide No. 100.0095
LILIDAASVAFLLIT

SEQ ID NO: 1023 - protein, 15 aa, Plasmodium falciparum
  MISC_FEATURE (1)..(15): Peptide No. 100.0096
AFLLITFLMINLNEE

SEQ ID NO: 1024 - protein, 15 aa, Plasmodium falciparum
  MISC_FEATURE (1)..(15): Peptide No. 100.0097
KKALVVAIILYVIFL

SEQ ID NO: 1025 - protein, 15 aa, Plasmodium falciparum
  MISC_FEATURE (1)..(15): Peptide No. 100.0098
VVAIILYVIFLVLLF

SEQ ID NO: 1026 - protein, 15 aa, Plasmodium falciparum
  MISC_FEATURE (1)..(15): Peptide No. 100.0099
ILYVIFLVLLFIYKA

SEQ ID NO: 1027 - protein, 15 aa, Plasmodium falciparum
  MISC_FEATURE (1)..(15): Peptide No. 100.0100
VIFLVLLFIYKAYKN

SEQ ID NO: 1028 - protein, 15 aa, Plasmodium falciparum
  MISC_FEATURE (1)..(15): Peptide No. 100.0101
LVLLFIYKAYKNKRK

SEQ ID NO: 1029 - protein, 15 aa, Plasmodium falciparum
  MISC_FEATURE (1)..(15): Peptide No. 100.0102
NFFMKKRNAPKYVQL

SEQ ID NO: 1030 - protein, 15 aa, Plasmodium falciparum
  MISC_FEATURE (1)..(15): Peptide No. 100.0103
PKYVQLASTYLSASD

SEQ ID NO: 1031 - protein, 15 aa, Plasmodium falciparum
  MISC_FEATURE (1)..(15): Peptide No. 100.0104
ENEYATGAVRPFQAA

SEQ ID NO: 1032 - protein, 15 aa, Plasmodium falciparum
  MISC_FEATURE (1)..(15): Peptide No. 100.0105
NYELSKKAVIFTPIY

SEQ ID NO: 1033 - protein, 15 aa, Plasmodium falciparum
  MISC_FEATURE (1)..(15): Peptide No. 100.0106
QKILIKIPVTKNIIT

SEQ ID NO: 1034 - protein, 15 aa, Plasmodium falciparum
  MISC_FEATURE (1)..(15): Peptide No. 100.0107
KCLVISQVSNSDSYK

SEQ ID NO: 1035 - protein, 15 aa, Plasmodium falciparum
  MISC_FEATURE (1)..(15): Peptide No. 100.0108
SKIMKLPKLPISNGK

SEQ ID NO: 1036 - protein, 15 aa, Plasmodium falciparum
  MISC_FEATURE (1)..(15): Peptide No. 100.0109
FIHFFTWGTMFVPKY

SEQ ID NO: 1037 - protein, 15 aa, Plasmodium falciparum
  MISC_FEATURE (1)..(15): Peptide No. 100.0110
LCNFKKNIIALLIIP

SEQ ID NO: 1038 - protein, 15 aa, Plasmodium falciparum
  MISC_FEATURE (1)..(15): Peptide No. 100.0111
KKNIIALLIIPPKIH

SEQ ID NO: 1039 - protein, 15 aa, Plasmodium falciparum
  MISC_FEATURE (1)..(15): Peptide No. 100.0112
ALLIIPPKIHISIEL

SEQ ID NO: 1040 - protein, 15 aa, Plasmodium falciparum
  MISC_FEATURE (1)..(15): Peptide No. 100.0113
SMEYKKDFLITARKP

SEQ ID NO: 1041 - protein, 15 aa, Plasmodium falciparum
  MISC_FEATURE (1)..(15): Peptide No. 100.0114
KSKFNILSSPLFNNF

SEQ ID NO: 1042 - protein, 15 aa, Plasmodium falciparum
  MISC_FEATURE (1)..(15): Peptide No. 100.0115
FKKLKNHVLFLQMMN

SEQ ID NO: 1043 - protein, 15 aa, Plasmodium falciparum
  MISC_FEATURE (1)..(15): Peptide No. 100.0116
KNHVLFLQMMNVNLQ

SEQ ID NO: 1044 - protein, 15 aa, Plasmodium falciparum
  MISC_FEATURE (1)..(15): Peptide No. 100.0117
VLFLQMMNVNLQKQL

SEQ ID NO: 1045 - protein, 15 aa, Plasmodium falciparum
  MISC_FEATURE (1)..(15): Peptide No. 100.0118
NVNLQKQLLTNHLIN

SEQ ID NO: 1046 - protein, 15 aa, Plasmodium falciparum
  MISC_FEATURE (1)..(15): Peptide No. 100.0119
QKQLLTNHLINTPKI

SEQ ID NO: 1047 - protein, 15 aa, Plasmodium falciparum
  MISC_FEATURE (1)..(15): Peptide No. 100.0120
NHLINTPKIMPHHII

SEQ ID NO: 1048 - protein, 15 aa, Plasmodium falciparum
  MISC_FEATURE (1)..(15): Peptide No. 100.0121
YILLKKILSSRFNQM

SEQ ID NO: 1049 - protein, 15 aa, Plasmodium falciparum
  MISC_FEATURE (1)..(15): Peptide No. 100.0122
FNQMIFVSSIFISFY

SEQ ID NO: 1050 - protein, 15 aa, Plasmodium falciparum
  MISC_FEATURE (1)..(15): Peptide No. 100.0123
CNILKENNTYKQKKH

SEQ ID NO: 1051 - protein, 15 aa, Plasmodium falciparum
  MISC_FEATURE (1)..(15): Peptide No. 100.0124
TNELKKMDTKKDVHM

SEQ ID NO: 1052 - protein, 15 aa, Plasmodium falciparum
  MISC_FEATURE (1)..(15): Peptide No. 100.0125
EVKFILHMTLLTLYK

SEQ ID NO: 1053 - protein, 15 aa, Plasmodium falciparum
  MISC_FEATURE (1)..(15): Peptide No. 100.0126
KYNFLNIYASLRNEY

SEQ ID NO: 1054 - protein, 15 aa, Plasmodium falciparum
  MISC_FEATURE (1)..(15): Peptide No. 100.0127
TRCFKNSYPKKVWKK

SEQ ID NO: 1055 - protein, 15 aa, Plasmodium falciparum
  MISC_FEATURE (1)..(15): Peptide No. 100.0128
NNLYVSMYIPFIKKF

SEQ ID NO: 1056 - protein, 15 aa, Plasmodium falciparum
  MISC_FEATURE (1)..(15): Peptide No. 100.0129
EAKFKIERLLKSSYK

SEQ ID NO: 1057 - protein, 15 aa, Plasmodium falciparum
  MISC_FEATURE (1)..(15): Peptide No. 100.0130
KIYILNNNLLIVHLS

SEQ ID NO: 1058 - protein, 15 aa, Plasmodium falciparum
  MISC_FEATURE (1)..(15): Peptide No. 100.0131
KCSFDKTNPIQQSGK

SEQ ID NO: 1059 - protein, 15 aa, Plasmodium falciparum
  MISC_FEATURE (1)..(15): Peptide No. 100.0132
TGIFNMPNLVQINNY

SEQ ID NO: 1060 - protein, 15 aa, Plasmodium falciparum
  MISC_FEATURE (1)..(15): Peptide No. 100.0133
EGMLTVAGPRSQTEL

SEQ ID NO: 1061 - protein, 15 aa, Plasmodium falciparum
  MISC_FEATURE (1)..(15): Peptide No. 100.0134
KQNIKYTQIISIDNI

SEQ ID NO: 1062 - protein, 15 aa, Plasmodium falciparum
  MISC_FEATURE (1)..(15): Peptide No. 100.0135
LNKIADPILIGFSSS

SEQ ID NO: 1063 - protein, 15 aa, Plasmodium falciparum
  MISC_FEATURE (1)..(15): Peptide No. 100.0136
NRIYNKLKLHKIIRK

SEQ ID NO: 1064 - protein, 15 aa, Plasmodium falciparum
  MISC_FEATURE (1)..(15): Peptide No. 100.0137
NNEYGILNAQKALSN

SEQ ID NO: 1065 - protein, 15 aa, Plasmodium falciparum
  MISC_FEATURE (1)..(15): Peptide No. 100.0138
YGILNAQKALSNLHK

SEQ ID NO: 1066 - protein, 15 aa, Plasmodium falciparum
  MISC_FEATURE (1)..(15): Peptide No. 100.0139
KIFVKYLPLFLMMEH

SEQ ID NO: 1067 - protein, 15 aa, Plasmodium falciparum
  MISC_FEATURE (1)..(15): Peptide No. 100.0140
PLFLMMEHSFLNCHK

SEQ ID NO: 1068 - protein, 15 aa, Plasmodium falciparum
  MISC_FEATURE (1)..(15): Peptide No. 100.0141
MEGFVALLSFLVVLV

SEQ ID NO: 1069 - protein, 15 aa, Plasmodium falciparum
  MISC_FEATURE (1)..(15): Peptide No. 100.0142
VDGMKIGHPISVALG

SEQ ID NO: 1070 - protein, 15 aa, Plasmodium falciparum
  MISC_FEATURE (1)..(15): Peptide No. 100.0143
GSTYMTPSAIKIKVP

SEQ ID NO: 1071 - protein, 15 aa, Plasmodium falciparum
  MISC_FEATURE (1)..(15): Peptide No. 100.0144
NNLFIYNWVLQTSSP

SEQ ID NO: 1072 - protein, 15 aa, Plasmodium falciparum
  MISC_FEATURE (1)..(15): Peptide No. 100.0145
EKILIRALLSLDFSL

SEQ ID NO: 1073 - protein, 15 aa, Plasmodium falciparum
  MISC_FEATURE (1)..(15): Peptide No. 100.0146
HPVYPTAPAVAFPAG

SEQ ID NO: 1074 - protein, 15 aa, Plasmodium falciparum
  MISC_FEATURE (1)..(15): Peptide No. 100.0147
EVYYFPGKVTRVRAK

SEQ ID NO: 1075 - protein, 15 aa, Plasmodium falciparum
  MISC_FEATURE (1)..(15): Peptide No. 100.0148
EDKLVKIYISLLSSD

SEQ ID NO: 1076 - protein, 15 aa, Plasmodium falciparum
  MISC_FEATURE (1)..(15): Peptide No. 100.0149
IERYVGLGSFHFYLY

SEQ ID NO: 1077 - protein, 15 aa, Plasmodium falciparum
  MISC_FEATURE (1)..(15): Peptide No. 100.0150
CFQVLNPVTIPKYCI

SEQ ID NO: 1078 - protein, 15 aa, Plasmodium falciparum
  MISC_FEATURE (1)..(15): Peptide No. 100.0151
FMSFKILEALLVCIS

SEQ ID NO: 1079 - protein, 15 aa, Plasmodium falciparum
  MISC_FEATURE (1)..(15): Peptide No. 100.0152
KQIVIFLISLLSFTL

SEQ ID NO: 1080 - protein, 15 aa, Plasmodium falciparum
  MISC_FEATURE (1)..(15): Peptide No. 100.0153
AKQIEILHTMLPNFL

SEQ ID NO: 1081 - protein, 15 aa, Plasmodium falciparum
  MISC_FEATURE (1)..(15): Peptide No. 100.0154
IDDFQNMVSTLQPHV

SEQ ID NO: 1082 - protein, 15 aa, Plasmodium falciparum
  MISC_FEATURE (1)..(15): Peptide No. 100.0155
KCAIKLAIAQLSAKY

SEQ ID NO: 1083 - protein, 15 aa, Plasmodium falciparum
  MISC_FEATURE (1)..(15): Peptide No. 100.0156
IGSVKPQYALFGDTV

SEQ ID NO: 1084 - protein, 15 aa, Plasmodium falciparum
  MISC_FEATURE (1)..(15): Peptide No. 100.0157
KIYIKKKRLLQMNNY

SEQ ID NO: 1085 - protein, 15 aa, Plasmodium falciparum
  MISC_FEATURE (1)..(15): Peptide No. 100.0158
KKLLKKLTSNLQLNK

SEQ ID NO: 1086 - protein, 15 aa, Plasmodium falciparum
  MISC_FEATURE (1)..(15): Peptide No. 100.0159
QDFLTKILPRQVLEE

SEQ ID NO: 1087 - protein, 15 aa, Plasmodium falciparum
  MISC_FEATURE (1)..(15): Peptide No. 100.0160
MWGLDVLIANKIESN

SEQ ID NO: 1088 - protein, 15 aa, Plasmodium falciparum
  MISC_FEATURE (1)..(15): Peptide No. 100.0161
FFILFYFYVMSTYTF

SEQ ID NO: 1089 - protein, 15 aa, Plasmodium falciparum
  MISC_FEATURE (1)..(15): Peptide No. 100.0162
TYTFCFLPVLQTQLG

SEQ ID NO: 1090 - protein, 15 aa, Plasmodium falciparum
  MISC_FEATURE (1)..(15): Peptide No. 100.0163
KKKYKNKKMPKTIDG

SEQ ID NO: 1091 - protein, 15 aa, Plasmodium falciparum
  MISC_FEATURE (1)..(15): Peptide No. 100.0164
GRAIIPLFLILNTYK

SEQ ID NO: 1092 - protein, 15 aa, Plasmodium falciparum
  MISC_FEATURE (1)..(15): Peptide No. 100.0165
KIIFKRNPLFLTFLS

SEQ ID NO: 1093 - protein, 15 aa, Plasmodium falciparum
  MISC_FEATURE (1)..(15): Peptide No. 100.0166
WLFFFDLVVLSPFSL

SEQ ID NO: 1094 - protein, 15 aa, Plasmodium falciparum
  MISC_FEATURE (1)..(15): Peptide No. 100.0167
KNIIKGKNMMTRGGG

SEQ ID NO: 1095 - protein, 15 aa, Plasmodium falciparum
  MISC_FEATURE (1)..(15): Peptide No. 100.0168
KMFIKGDTVMKANII

SEQ ID NO: 1096 - protein, 15 aa, Plasmodium falciparum
  MISC_FEATURE (1)..(15): Peptide No. 100.0169
VGSYKLMISQEAEFE

SEQ ID NO: 1097 - protein, 15 aa, Plasmodium falciparum
  MISC_FEATURE (1)..(15): Peptide No. 100.0170
LNRFITLITWTQHVS

SEQ ID NO: 1098 - protein, 15 aa, Plasmodium falciparum
  MISC_FEATURE (1)..(15): Peptide No. 100.0171
RTKYETLVTIHVHQR

SEQ ID NO: 1099 - protein, 15 aa, Plasmodium falciparum
  MISC_FEATURE (1)..(15): Peptide No. 100.0172
GLCYGGAPAGPAGTG

SEQ ID NO: 1100 - protein, 15 aa, Plasmodium falciparum
  MISC_FEATURE (1)..(15): Peptide No. 100.0173
DSILILQTINLLNSQ

SEQ ID NO: 1101 - protein, 15 aa, Plasmodium falciparum
  MISC_FEATURE (1)..(15): Peptide No. 100.0174
KHLIIINRVMQTPNG

SEQ ID NO: 1102 - protein, 15 aa, Plasmodium falciparum
  MISC_FEATURE (1)..(15): Peptide No. 100.0175
IDLYKQMYVKKYDEI

SEQ ID NO: 1103 - protein, 15 aa, Plasmodium falciparum
  MISC_FEATURE (1)..(15): Peptide No. 100.0176
DKDLKAALPYLHEAE

SEQ ID NO: 1104 - protein, 15 aa, Plasmodium falciparum
  MISC_FEATURE (1)..(15): Peptide No. 100.0177
TIELLKPYIQSTFFK

SEQ ID NO: 1105 - protein, 15 aa, Plasmodium falciparum
  MISC_FEATURE (1)..(15): Peptide No. 100.0178
STFFKTQIAKKASVA

SEQ ID NO: 1106 - protein, 15 aa, Plasmodium falciparum
  MISC_FEATURE (1)..(15): Peptide No. 100.0179
CKWVGAMAMYNQASK

SEQ ID NO: 1107 - protein, 15 aa, Plasmodium falciparum
  MISC_FEATURE (1)..(15): Peptide No. 100.0180
AMAMYNQASKIVKPK

SEQ ID NO: 1108 - protein, 15 aa, Plasmodium falciparum
  MISC_FEATURE (1)..(15): Peptide No. 100.0181
INFFILLTLVFQKYS

SEQ ID NO: 1109 - protein, 15 aa, Plasmodium falciparum
  MISC_FEATURE (1)..(15): Peptide No. 100.0182
NNNLGIPTLIKKEVH

SEQ ID NO: 1110 - protein, 15 aa, Plasmodium falciparum
  MISC_FEATURE (1)..(15): Peptide No. 100.0183
EEDIKNAYLPENKNF

SEQ ID NO: 1111 - protein, 15 aa, Plasmodium falciparum
  MISC_FEATURE (1)..(15): Peptide No. 100.0184
INVFIKEISKLFDHD

SEQ ID NO: 1112 - protein, 15 aa, Plasmodium falciparum
  MISC_FEATURE (1)..(15): Peptide No. 100.0185
DKSLKIMYSLFNKYT

SEQ ID NO: 1113 - protein, 15 aa, Plasmodium falciparum
  MISC_FEATURE (1)..(15): Peptide No. 100.0186
VVIFIYGNIIISDLK

SEQ ID NO: 1114 - protein, 15 aa, Plasmodium falciparum
  MISC_FEATURE (1)..(15): Peptide No. 100.0187
CESFISKVTNKVIKK

SEQ ID NO: 1115 - protein, 15 aa, Plasmodium falciparum
  MISC_FEATURE (1)..(15): Peptide No. 100.0188
ICTFVKYITFQLLNI

SEQ ID NO: 1116 - protein, 15 aa, Plasmodium falciparum
  MISC_FEATURE (1)..(15): Peptide No. 100.0189
KEHYIMNNTIFTFNQ

SEQ ID NO: 1117 - protein, 15 aa, Plasmodium falciparum
  MISC_FEATURE (1)..(15): Peptide No. 100.0190
KKKYKYIPSNGTTQS

SEQ ID NO: 1118 - protein, 15 aa, Plasmodium falciparum
  MISC_FEATURE (1)..(15): Peptide No. 100.0191
EKSLGILGSIQNAYL

SEQ ID NO: 1119 - protein, 15 aa, Plasmodium falciparum
  MISC_FEATURE (1)..(15): Peptide No. 100.0192
LGSIQNAYLYKSIFK

SEQ ID NO: 1120 - protein, 15 aa, Plasmodium falciparum
  MISC_FEATURE (1)..(15): Peptide No. 100.0193
SCIMNNMIVTKESNE

SEQ ID NO: 1121 - protein, 15 aa, Plasmodium falciparum
  MISC_FEATURE (1)..(15): Peptide No. 100.0194
KDFMKNNTTLFSHFN

SEQ ID NO: 1122 - protein, 15 aa, Plasmodium falciparum
  MISC_FEATURE (1)..(15): Peptide No. 100.0195
MLYLIRNILMSIEDY

SEQ ID NO: 1123 - protein, 15 aa, Plasmodium falciparum
  MISC_FEATURE (1)..(15): Peptide No. 100.0196
KKKYIKLNIFKNIIL

SEQ ID NO: 1124 - protein, 15 aa, Plasmodium falciparum
  MISC_FEATURE (1)..(15): Peptide No. 100.0197
RWDLVMNMMIGIRIS

SEQ ID NO: 1125 - protein, 15 aa, Plasmodium falciparum
  MISC_FEATURE (1)..(15): Peptide No. 100.0198
HKDVIQLPTSNAQHK

SEQ ID NO: 1126 - protein, 15 aa, Plasmodium falciparum
  MISC_FEATURE (1)..(15): Peptide No. 100.0199
HKVIFKNYAPIIFKN

SEQ ID NO: 1127 - protein, 15 aa, Plasmodium falciparum
  MISC_FEATURE (1)..(15): Peptide No. 100.0200
SNMVLGNLSTLSELL

SEQ ID NO: 1128 - protein, 15 aa, Plasmodium falciparum
  MISC_FEATURE (1)..(15): Peptide No. 100.0201
AKFYNGGEIMQPNSK

SEQ ID NO: 1129 - protein, 15 aa, Plasmodium falciparum
  MISC_FEATURE (1)..(15): Peptide No. 100.0202
KRNLKLQNAIKNCRG

SEQ ID NO: 1130 - protein, 15 aa, Plasmodium falciparum
  MISC_FEATURE (1)..(15): Peptide No. 100.0203
HVKIIKNLLIHGKEQ

SEQ ID NO: 1131 - protein, 15 aa, Plasmodium falciparum
  MISC_FEATURE (1)..(15): Peptide No. 100.0204
KYKLLYLQAQTTAAN

SEQ ID NO: 1132 - protein, 15 aa, Plasmodium falciparum
  MISC_FEATURE (1)..(15): Peptide No. 100.0205
LLYLQAQTTAANGGP

SEQ ID NO: 1133 - protein, 15 aa, Plasmodium falciparum
  MISC_FEATURE (1)..(15): Peptide No. 100.0206
SPKIVVPAPKPTTTF

SEQ ID NO: 1134 - protein, 15 aa, Plasmodium falciparum
  MISC_FEATURE (1)..(15): Peptide No. 100.0207
FVDLIRQIAATIDKG

SEQ ID NO: 1135 - protein, 15 aa, Plasmodium falciparum
  MISC_FEATURE (1)..(15): Peptide No. 100.0208
QERLVKNPLVQPTLK

SEQ ID NO: 1136 - protein, 15 aa, Plasmodium falciparum
  MISC_FEATURE (1)..(15): Peptide No. 100.0209
HPAVIPALVTSTLAW

SEQ ID NO: 1137 - protein, 15 aa, Plasmodium falciparum
  MISC_FEATURE (1)..(15): Peptide No. 100.0210
NELFGTNHVKQTSIH

SEQ ID NO: 1138 - protein, 15 aa, Plasmodium falciparum
  MISC_FEATURE (1)..(15): Peptide No. 100.0211
NNEFVVAQLYELNNY

SEQ ID NO: 1139 - protein, 15 aa, Plasmodium falciparum
  MISC_FEATURE (1)..(15): Peptide No. 100.0212
DNNMKKYLIQKCGKK

SEQ ID NO: 1140 - protein, 15 aa, Plasmodium falciparum
  MISC_FEATURE (1)..(15): Peptide No. 100.0213
SCSIIKYELRKTSIC

SEQ ID NO: 1141 - protein, 15 aa, Plasmodium falciparum
  MISC_FEATURE (1)..(15): Peptide No. 100.0214
RNHMDKPPPHNINNN

SEQ ID NO: 1142 - protein, 15 aa, Plasmodium falciparum
  MISC_FEATURE (1)..(15): Peptide No. 100.0215
NNNLIFQNSRFMDHT

SEQ ID NO: 1143 - protein, 15 aa, Plasmodium falciparum
  MISC_FEATURE (1)..(15): Peptide No. 100.0216
THDIIKNVSNNMKRF

SEQ ID NO: 1144 - protein, 15 aa, Plasmodium falciparum
  MISC_FEATURE (1)..(15): Peptide No. 100.0217
FKNVDMLNIYKINKD

SEQ ID NO: 1145 - protein, 15 aa, Plasmodium falciparum
  MISC_FEATURE (1)..(15): Peptide No. 100.0218
MKDVINLYTYVVNKK

SEQ ID NO: 1146 - protein, 15 aa, Plasmodium falciparum
  MISC_FEATURE (1)..(15): Peptide No. 100.0219
GMYILPQYVTRECIN

SEQ ID NO: 1147 - protein, 15 aa, Plasmodium falciparum
  MISC_FEATURE (1)..(15): Peptide No. 100.0220
GDDVIYEETKKTDNI

SEQ ID NO: 1148 - protein, 15 aa, Plasmodium falciparum
  MISC_FEATURE (1)..(15): Peptide No. 100.0221
FKSLKNNNMLESTGI

SEQ ID NO: 1149 - protein, 15 aa, Plasmodium falciparum
  MISC_FEATURE (1)..(15): Peptide No. 100.0222
FLDYVKGKMMDVYKE

SEQ ID NO: 1150 - protein, 15 aa, Plasmodium falciparum
  MISC_FEATURE (1)..(15): Peptide No. 100.0223
TYNYLTPTLKVKRFR

SEQ ID NO: 1151 - protein, 15 aa, Plasmodium falciparum
  MISC_FEATURE (1)..(15): Peptide No. 100.0224
NDLIDQNIVYLNVCN

SEQ ID NO: 1152 - protein, 15 aa, Plasmodium falciparum
  MISC_FEATURE (1)..(15): Peptide No. 100.0225
LKKLKKILLNLDVLI

SEQ ID NO: 1153 - protein, 15 aa, Plasmodium falciparum
  MISC_FEATURE (1)..(15): Peptide No. 100.0226
NENFDMELLNNVNDR

SEQ ID NO: 1154 - protein, 15 aa, Plasmodium falciparum
  MISC_FEATURE (1)..(15): Peptide No. 100.0227
NCPIKNEVTTLIQKI

SEQ ID NO: 1155 - protein, 15 aa, Plasmodium falciparum
  MISC_FEATURE (1)..(15): Peptide No. 100.0228
EKNMTSQKSITSEKN

SEQ ID NO: 1156 - protein, 15 aa, Plasmodium falciparum
  MISC_FEATURE (1)..(15): Peptide No. 100.0229
NSNFKEQHLLFCNNL

SEQ ID NO: 1157 - protein, 15 aa, Plasmodium falciparum
  MISC_FEATURE (1)..(15): Peptide No. 100.0230
NNNIKTHIANFNIIH

SEQ ID NO: 1158 - protein, 15 aa, Plasmodium falciparum
  MISC_FEATURE (1)..(15): Peptide No. 100.0231
NNLYKTYEMIQGDND

SEQ ID NO: 1159 - protein, 15 aa, Plasmodium falciparum
  MISC_FEATURE (1)..(15): Peptide No. 100.0232
NDNYINNNIYLNKAN

SEQ ID NO: 1160 - protein, 15 aa, Plasmodium falciparum
  MISC_FEATURE (1)..(15): Peptide No. 100.0233
FLQYRIPHMNNNGNI

SEQ ID NO: 1161 - protein, 15 aa, Plasmodium falciparum
  MISC_FEATURE (1)..(15): Peptide No. 100.0234
VDIFCKIHALKNENK

The invention claimed is:

1. An isolated or purified polynucleotide: a) encoding a polypeptide comprising SEQ ID NO: 1; b) encoding a Human Leukocyte Antigen (HLA) binding fragment of SEQ ID NO: 1, wherein said HLA binding fragment comprises the amino acid sequence selected from Lys-Thr-Asn-Lys-Trp-Glu-Asp-Ile-Tyr (SEQ ID NO:28), Lys-Ser-Ile-Tyr-Ile-Phe-Tyr-Thr-Tyr (SEQ ID NO:29), Gly-Thr-Phe-Thr-Phe-Gln-Asn-Met-Tyr (SEQ ID NO:30), Tyr-Phe-Glu-Cys-Ile-Met-Lys-Leu-Tyr (SEQ ID NO:32), Val-Tyr-Glu-Gly-Lys-Leu-Lys-Lys-Tyr (SEQ ID NO:33), Val-Val-Asp-Leu-Phe-Cys-Gly-Val-Gly-Tyr (SEQ ID NO:34), Phe-Ser-Ser-Ile-Asn-Thr-Tyr-Asp-Tyr (SEQ ID NO:35), Val-Ser-Asn-Val-Glu-Asp-Ser-Asn-Tyr (SEQ ID NO:36), or Asn-Ser-Asn-Tyr-Asn-Lys-Lys-Leu-Tyr (SEQ ID NO:37); or c) that is complementary along the full length of said polynucleotide of a) or b).

2. The isolated or purified polynucleotide according to claim 1, wherein said polynucleotide encodes said polypeptide comprising SEQ ID NO: 1.

3. The isolated or purified polynucleotide according to claim 1, wherein said polynucleotide encodes said HLA binding fragment.

4. The isolated or purified polynucleotide according to claim 1, wherein said polynucleotide is complementary along the full length of said polynucleotide of a).

5. The isolated or purified polynucleotide according to claim 1, wherein said polynucleotide is complementary along the full length of said polynucleotide of b).

6. The isolated or purified polynucleotide according to claim 1, wherein said polynucleotide encodes said HLA binding fragment, and wherein said HLA binding fragment has a length selected from the group consisting of 10, 11, 12, 13, 14, 15, 16, 17, 18, 19, 20, 21, 22, 23, 24, 25, 26, 27, 28, 29, 30, 31, 32, 33, 34, and 35 amino acids.

7. The isolated or purified polynucleotide according to claim 1, wherein said polynucleotide encodes said HLA binding fragment, and wherein said HLA binding fragment consists of the amino acid sequence selected from Lys-Thr-Asn-Lys-Trp-Glu-Asp-Ile-Tyr (SEQ ID NO:28), Lys-Ser-Ile-Tyr-Ile-Phe-Tyr-Thr-Tyr (SEQ ID NO:29), Gly-Thr-Phe-Thr-Phe-Gln-Asn-Met-Tyr (SEQ ID NO:30), Tyr-Phe-Glu-Cys-Ile-Met-Lys-Leu-Tyr (SEQ ID NO:32), Val-Tyr-Glu-Gly-Lys-Leu-Lys-Lys-Tyr (SEQ ID NO:33), Val-Val-Asp-Leu-Phe-Cys-Gly-Val-Gly-Tyr (SEQ ID NO:34), Phe-Ser-Ser- Ile-Asn-Thr-Tyr-Asp-Tyr (SEQ ID NO:35), Val-Ser-Asn-Val-Glu-Asp-Ser-Asn-Tyr (SEQ ID NO:36), or Asn-Ser-Asn-Tyr-Asn-Lys-Lys-Leu-Tyr (SEQ ID NO:37).

8. The isolated or purified polynucleotide according to claim 1, wherein said polynucleotide encodes said HLA binding fragment or is complementary along the full length of said polynucleotide of b), and wherein said HLA binding fragment comprises Lys-Thr-Asn-Lys-Trp-Glu-Asp-Ile-Tyr (SEQ ID NO:28).

9. The isolated or purified polynucleotide according to claim 1, wherein said polynucleotide encodes said HLA binding fragment or is complementary along the full length of said polynucleotide of b), and wherein said HLA binding fragment comprises Lys-Ser-Ile-Tyr-Ile-Phe-Tyr-Thr-Tyr (SEQ ID NO:29).

10. The isolated or purified polynucleotide according to claim 1, wherein said polynucleotide encodes said HLA binding fragment or is complementary along the full length of said polynucleotide of b), and wherein said HLA binding fragment comprises Gly-Thr-Phe-Thr-Phe-Gln-Asn-Met-Tyr (SEQ ID NO:30).

11. The isolated or purified polynucleotide according to claim 1, wherein said polynucleotide encodes said HLA binding fragment or is complementary along the full length of said polynucleotide of b), and wherein said HLA binding fragment comprises Tyr-Phe-Glu-Cys-Ile-Met-Lys-Leu-Tyr (SEQ ID NO:32).

12. The isolated or purified polynucleotide according to claim 1, wherein said polynucleotide encodes said HLA binding fragment or is complementary along the full length of said polynucleotide of b), and wherein said HLA binding fragment comprises Val-Tyr-Glu-Gly-Lys-Leu-Lys-Lys-Tyr (SEQ ID NO:33).

13. The isolated or purified polynucleotide according to claim 1, wherein said polynucleotide encodes said HLA binding fragment or is complementary along the full length of said polynucleotide of b), and wherein said HLA binding fragment comprises Val-Val-Asp-Leu-Phe-Cys-Gly-Val-Gly-Tyr (SEQ ID NO:34).

14. The isolated or purified polynucleotide according to claim 1, wherein said polynucleotide encodes said HLA binding fragment or is complementary along the full length of said polynucleotide of b), and wherein said HLA binding fragment comprises Phe-Ser-Ser-Ile-Asn-Thr-Tyr-Asp-Tyr (SEQ ID NO:35).

15. The isolated or purified polynucleotide according to claim 1, wherein said polynucleotide encodes said HLA binding fragment or is complementary along the full length of said polynucleotide of b), and wherein said HLA binding fragment comprises Val-Ser-Asn-Val-Glu-Asp-Ser-Asn-Tyr (SEQ ID NO:36).

16. The isolated or purified polynucleotide according to claim 1, wherein said polynucleotide encodes said HLA binding fragment or is complementary along the full length of said polynucleotide of b), and wherein said HLA binding fragment comprises Asn-Ser-Asn-Tyr-Asn-Lys-Lys-Leu-Tyr (SEQ ID NO:37).

17. A vector comprising a promoter operably linked to a polynucleotide:
  a) encoding a polypeptide comprising SEQ ID NO: 1; b) encoding a Human Leukocyte Antigen (HLA) binding fragment of SEQ ID NO: 1, wherein said HLA binding fragment comprises the amino acid sequence selected from Lys-Thr-Asn-Lys-Trp-Glu-Asp-Ile-Tyr (SEQ ID NO:28), Lys-Ser-Ile-Tyr-Ile-Phe-Tyr-Thr-Tyr (SEQ ID NO:29), Gly-Thr-Phe-Thr-Phe-Gln-Asn-Met-Tyr (SEQ ID NO:30), Tyr-Phe-Glu-Cys-Ile-Met-Lys-Leu-Tyr (SEQ ID NO:32), Val-Tyr-Glu-Gly-Lys-Leu-Lys-Lys-Tyr (SEQ ID NO:33), Val-Val-Asp-Leu-Phe-Cys-Gly-Val-Gly-Tyr (SEQ ID NO:34), Phe-Ser-Ser-Ile-Asn-Thr-Tyr-Asp-Tyr (SEQ ID NO:35), Val-Ser-Asn-Val-Glu-Asp-Ser-Asn-Tyr (SEQ ID NO:36), or Asn-Ser-Asn-Tyr-Asn-Lys-Lys-Leu-Tyr (SEQ ID NO:37); or
  c) that is complementary along the full length of said polynucleotide of a) or b).

18. The vector according to claim 17, wherein said polynucleotide encodes said polypeptide comprising SEQ ID NO: 1.

19. The vector according to claim 17, wherein said polynucleotide encodes said HLA binding fragment.

20. The vector according to claim 17, wherein said polynucleotide is complementary along the full length of said polynucleotide of a).

21. The vector according to claim 17, wherein said polynucleotide is complementary along the full length of said polynucleotide of b).

22. The vector according to claim 17, wherein said polynucleotide encodes said HLA binding fragment, and wherein said HLA binding fragment has a length selected from the group consisting of 10, 11, 12, 13, 14, 15, 16, 17, 18, 19, 20, 21, 22, 23, 24, 25, 26, 27, 28, 29, 30, 31, 32, 33, 34, and 35 amino acids.

23. The vector according to claim 17, wherein said polynucleotide encodes said HLA binding fragment, and wherein said HLA binding fragment consists of the amino acid sequence selected from Lys-Thr-Asn-Lys-Trp-Glu-Asp-Ile-Tyr (SEQ ID NO:28), Lys-Ser-Ile-Tyr-Ile-Phe-Tyr-Thr-Tyr (SEQ ID NO:29), Gly-Thr-Phe-Thr-Phe-Gln-Asn-Met-Tyr (SEQ ID NO:30), Tyr-Phe-Glu-Cys-Ile-Met-Lys-Leu-Tyr (SEQ ID NO:32), Val-Tyr-Glu-Gly-Lys-Leu-Lys-Lys-Tyr (SEQ ID NO:33), Val-Val-Asp-Leu-Phe-Cys-Gly-Val-Gly-Tyr (SEQ ID NO:34), Phe-Ser-Ser-Ile-Asn-Thr-Tyr-Asp-Tyr (SEQ ID NO:35), Val-Ser-Asn-Val-Glu-Asp-Ser-Asn-Tyr (SEQ ID NO:36), or Asn-Ser-Asn-Tyr-Asn-Lys-Lys-Leu-Tyr (SEQ ID NO:37).

24. An isolated transformed host cell comprising a polynucleotide:
  a) encoding a polypeptide comprising SEQ ID NO: 1;
  b) encoding a Human Leukocyte Antigen (HLA) binding fragment of SEQ ID NO: 1, wherein said HLA binding fragment comprises the amino acid sequence selected from Lys-Thr-Asn-Lys-Trp-Glu-Asp-Ile-Tyr (SEQ ID NO:28), Lys-Ser-Ile-Tyr-Ile-Phe-Tyr-Thr-Tyr (SEQ ID NO:29), Gly-Thr-Phe-Thr-Phe-Gln-Asn-Met-Tyr (SEQ ID NO:30), Tyr-Phe-Glu-Cys-Ile-Met-Lys-Leu-Tyr (SEQ ID NO:32), Val-Tyr-Glu-Gly-Lys-Leu-Lys-Lys-Tyr (SEQ ID NO:33), Val-Val-Asp-Leu-Phe-Cys-Gly-Val-Gly-Tyr (SEQ ID NO:34), Phe-Ser-Ser-Ile-Asn-Thr-Tyr-Asp-Tyr (SEQ ID NO:35), Val-Ser-Asn-Val-Glu-Asp-Ser-Asn-Tyr (SEQ ID NO:36), or Asn-Ser-Asn-Tyr-Asn-Lys-Lys-Leu-Tyr (SEQ ID NO:37); or
  c) that is complementary along the full length of said polynucleotide of a) or b).

25. The isolated transformed host cell according to claim 24, wherein said polynucleotide encodes said polypeptide comprising SEQ ID NO: 1.

26. The isolated transformed host cell according to claim 24, wherein said polynucleotide encodes said HLA binding fragment.

27. The isolated transformed host cell according to claim 24, wherein said polynucleotide is complementary along the full length of said polynucleotide of a).

28. The isolated transformed host cell according to claim 24, wherein said polynucleotide is complementary along the full length of the polynucleotide of b).

29. An isolated transformed host cell according to claim 24, wherein said polynucleotide is a vector comprising a promoter operably linked to a polynucleotide:
  a) encoding a polypeptide comprising SEQ ID NO: 1;
  b) encoding a Human Leukocyte Antigen (HLA) binding fragment of SEQ ID NO: 1, wherein said HLA binding fragment comprises the amino acid sequence selected from Lys-Thr-Asn-Lys-Trp-Glu-Asp-Ile-Tyr (SEQ ID NO:28), Lys-Ser-Ile-Tyr-Ile-Phe-Tyr-Thr-Tyr (SEQ ID NO:29), Gly-Thr-Phe-Thr-Phe-Gln-Asn-Met-Tyr (SEQ ID NO:30), Tyr-Phe-Glu-Cys-Ile-Met-Lys-Leu-Tyr (SEQ ID NO:32), Val-Tyr-Glu-Gly-Lys-Leu-Lys-Lys-Tyr (SEQ ID NO:33), Val-Val-Asp-Leu-Phe-Cys-Gly-Val-Gly-Tyr (SEQ ID NO:34), Phe-Ser-Ser-Ile-Asn-Thr-Tyr-Asp-Tyr (SEQ ID NO:35), Val-Ser-Asn-Val-Glu-Asp-Ser-Asn-Tyr (SEQ ID NO:36), or Asn-Ser-Asn-Tyr-Asn-Lys-Lys-Leu-Tyr (SEQ ID NO:37); or
  c) that is complementary along the full length of said polynucleotide of a) or b).

30. The isolated transformed host cell according to claim 29, wherein said polynucleotide encodes said polypeptide comprising SEQ ID NO: 1.

31. The isolated transformed host cell according to claim 29, wherein said polynucleotide encodes said HLA binding fragment.

32. The isolated transformed host cell according to claim 29, wherein said polynucleotide is complementary along the full length of said polynucleotide of a).

33. The isolated transformed host cell according to claim 29, wherein said polynucleotide is complementary along the full length of said polynucleotide of b).

34. The isolated transformed host cell according to claim 29, wherein said polynucleotide encodes said HLA binding fragment, and wherein said HLA binding fragment has a length selected from the group consisting of 10, 11, 12, 13, 14, 15, 16, 17, 18, 19, 20, 21, 22, 23, 24, 25, 26, 27, 28, 29, 30, 31, 32, 33, 34, and 35 amino acids.

35. The isolated transformed host cell according to claim 29, wherein said polynucleotide encodes said HLA binding fragment, and wherein said HLA binding fragment consists of the amino acid sequence selected from Lys-Thr-Asn-Lys-Trp-Glu-Asp-Ile-Tyr (SEQ ID NO:28), Lys-Ser-Ile-Tyr-Ile-Phe-Tyr-Thr-Tyr (SEQ ID NO:29), Gly-Thr-Phe-Thr-Phe-Gln-Asn-Met-Tyr (SEQ ID NO:30), Tyr-Phe-Glu-Cys-Ile-Met-Lys-Leu-Tyr (SEQ ID NO:32), Val-Tyr-Glu-Gly-Lys-Leu-Lys-Lys-Tyr (SEQ ID NO:33), Val-Val-Asp-Leu-Phe-Cys-Gly-Val-Gly-Tyr (SEQ ID NO:34), Phe-Ser-Ser-Ile-Asn-Thr-Tyr-Asp-Tyr (SEQ ID NO:35), Val-Ser-Asn-Val-Glu-Asp-Ser-Asn-Tyr (SEQ ID NO:36), or Asn-Ser-Asn-Tyr-Asn-Lys-Lys-Leu-Tyr (SEQ ID NO:37).

36. A method of making a polypeptide comprising culturing an isolated transformed host cell according to claim 24 under conditions that allow for the production of said polypeptide.

37. The isolated transformed host cell according to claim 24, wherein said polynucleotide encodes said HLA binding fragment, and wherein said HLA binding fragment has a length selected from the group consisting of 10, 11, 12, 13, 14, 15, 16, 17, 18, 19, 20, 21, 22, 23, 24, 25, 26, 27, 28, 29, 30, 31, 32, 33, 34, and 35 amino acids.

38. The isolated transformed host cell according to claim 24, wherein said polynucleotide encodes said HLA binding fragment, and wherein said HLA binding fragment consists of the amino acid sequence selected from Lys-Thr-Asn-Lys-Trp-Glu-Asp-Ile-Tyr (SEQ ID NO:28), Lys-Ser-Ile-Tyr-Ile-Phe-Tyr-Thr-Tyr (SEQ ID NO:29), Gly-Thr-Phe-Thr-Phe-Gln-Asn-Met-Tyr (SEQ ID NO:30), Tyr-Phe-Glu-Cys-Ile-Met-Lys-Leu-Tyr (SEQ ID NO:32), Val-Tyr-Glu-Gly-Lys-Leu-Lys-Lys-Tyr (SEQ ID NO:33), Val-Val-Asp-Leu-Phe-Cys-Gly-Val-Gly-Tyr (SEQ ID NO:34), Phe-Ser-Ser-Ile-Asn-Thr-Tyr-Asp-Tyr (SEQ ID NO:35), Val-Ser-Asn-Val-Glu-Asp-Ser-Asn-Tyr (SEQ ID NO:36), or Asn-Ser-Asn-Tyr-Asn-Lys-Lys-Leu-Tyr (SEQ ID NO:37).

* * * * *